United States Patent
Falb et al.

(10) Patent No.: US 11,471,494 B2
(45) Date of Patent: *Oct. 18, 2022

(54) MICROORGANISMS PROGRAMMED TO PRODUCE IMMUNE MODULATORS AND ANTI-CANCER THERAPEUTICS IN TUMOR CELLS

(71) Applicant: Synlogic Operating Company, Inc., Cambridge, MA (US)

(72) Inventors: Dean Falb, Sherborn, MA (US); Jonathan W. Kotula, Berkeley, CA (US); Vincent M. Isabella, Medford, MA (US); Paul F. Miller, Salem, CT (US); Suman Machinani, Monroe, NY (US); Saurabh Saha, Wellesley Hills, MA (US); Adam B. Fisher, Cambridge, MA (US); Yves Millet, Newton, MA (US); Ning Li, Winchester, MA (US); Jose M. Lora, Boston, MA (US)

(73) Assignee: Synlogic Operating Company, Inc., Cambridge, MA (US)

( * ) Notice: Subject to any disclaimer, the term of this patent is extended or adjusted under 35 U.S.C. 154(b) by 455 days.

This patent is subject to a terminal disclaimer.

(21) Appl. No.: 16/474,383

(22) PCT Filed: Jan. 5, 2018

(86) PCT No.: PCT/US2018/012698
§ 371 (c)(1),
(2) Date: Jun. 27, 2019

(87) PCT Pub. No.: WO2018/129404
PCT Pub. Date: Jul. 12, 2018

(65) Prior Publication Data
US 2019/0336544 A1 Nov. 7, 2019

Related U.S. Application Data

(63) Continuation-in-part of application No. PCT/US2017/013072, filed on Jan. 11, 2017.

(60) Provisional application No. 62/443,639, filed on Jan. 6, 2017, provisional application No. 62/443,634, filed on Jan. 6, 2017, provisional application No. 62/531,784, filed on Jul. 12, 2017, provisional application No. 62/543,322, filed on Aug. 9, 2017, provisional application No. 62/552,319, filed on Aug. 30, 2017, provisional application No. 62/592,317, filed on Nov. 29, 2017, provisional application No. 62/607,210, filed on Dec. 18, 2017.

(51) Int. Cl.
| | | |
|---|---|---|
| A61K 35/74 | (2015.01) | |
| C07K 14/52 | (2006.01) | |
| C07K 14/525 | (2006.01) | |
| C07K 14/53 | (2006.01) | |
| C07K 14/54 | (2006.01) | |
| C07K 14/57 | (2006.01) | |
| C07K 14/705 | (2006.01) | |
| C07K 16/28 | (2006.01) | |
| C12N 9/26 | (2006.01) | |
| C12N 15/62 | (2006.01) | |
| C12N 15/74 | (2006.01) | |
| A61K 33/243 | (2019.01) | |

(52) U.S. Cl.
CPC ............ *A61K 35/74* (2013.01); *C07K 14/521* (2013.01); *C07K 14/525* (2013.01); *C07K 14/53* (2013.01); *C07K 14/5434* (2013.01); *C07K 14/5443* (2013.01); *C07K 14/57* (2013.01); *C07K 14/70575* (2013.01); *C07K 14/70596* (2013.01); *C07K 16/2818* (2013.01); *C12N 9/2408* (2013.01); *C12N 15/62* (2013.01); *C12N 15/74* (2013.01); *A61K 33/243* (2019.01); *C07K 2317/622* (2013.01); *C07K 2319/21* (2013.01); *C12N 2840/002* (2013.01); *C12Y 302/01003* (2013.01); *C12Y 302/01035* (2013.01)

(58) Field of Classification Search
CPC ......... A61K 35/74; A61P 35/00; C12N 15/70; C12N 15/74; C12N 9/00; C12Y 7/07
See application file for complete search history.

(56) References Cited

U.S. PATENT DOCUMENTS

| | | | |
|---|---|---|---|
| 8,716,301 | B2 | 5/2014 | Sitkovsky et al. |
| 2004/0229338 | A1 | 11/2004 | King |
| 2005/0220799 | A1 | 10/2005 | Sitkovsky et al. |
| 2010/0255036 | A1 | 10/2010 | Hassan et al. |
| 2013/0295054 | A1 | 11/2013 | Huang et al. |
| 2014/0093885 | A1 | 4/2014 | Hua et al. |

(Continued)

FOREIGN PATENT DOCUMENTS

| | | |
|---|---|---|
| EP | 3141602 A1 | 3/2017 |
| JP | 2016-538344 A | 12/2016 |

(Continued)

OTHER PUBLICATIONS

Oelschlaeger 2010. Bacteria as tumor therapeutics? Bioengineered Bugs. 1(2): 146-147.*
Chassoux et al. 1975; Therapeutic effect of intrtumoral injection of BCG and other sustances in rats and mice. Int. J. Cancer. 16: 515-525.*
U.S. Appl. No. 16/619,010, filed Dec. 3, 2019, Pending.
International Preliminary Report on Patentability for Application No. PCT/US2018/041705, dated Jan. 23, 2020, 16 pages.

(Continued)

*Primary Examiner* — Karen Cochrane Carlson
(74) *Attorney, Agent, or Firm* — McCarter & English, LLP; Marcie B. Clarke

(57) ABSTRACT

Genetically programmed microorganisms, such as bacteria or virus, pharmaceutical compositions thereof, and methods of modulating and treating cancers are disclosed.

10 Claims, 61 Drawing Sheets
Specification includes a Sequence Listing.

(56) References Cited

U.S. PATENT DOCUMENTS

| | | | |
|---|---|---|---|
| 2014/0178341 | A1 | 6/2014 | Zhao et al. |
| 2016/0058845 | A1 | 3/2016 | Georgiou et al. |
| 2018/0028577 | A1* | 2/2018 | Bishai .................... A61K 35/74 |
| 2019/0160115 | A1 | 5/2019 | Falb et al. |
| 2019/0336544 | A1* | 11/2019 | Falb ............... C12Y 307/01003 |
| 2020/0071702 | A1 | 3/2020 | Thanos et al. |
| 2020/0149053 | A1 | 5/2020 | Fisher et al. |
| 2020/0215123 | A1 | 7/2020 | Thanos et al. |
| 2022/0023358 | A1 | 1/2022 | Lora et al. |

FOREIGN PATENT DOCUMENTS

| | | |
|---|---|---|
| WO | 2007/123737 A2 | 11/2007 |
| WO | 2008/073148 A2 | 6/2008 |
| WO | 2014/198002 A1 | 12/2014 |
| WO | 2015/077354 A1 | 5/2015 |
| WO | 2015/078840 A1 | 6/2015 |
| WO | 2015/166640 A1 | 11/2015 |
| WO | 2016/033488 A1 | 3/2016 |
| WO | 2016/106178 A1 | 6/2016 |
| WO | 2016/130616 A1 | 8/2016 |
| WO | 2016/183532 A1 | 11/2016 |
| WO | 2016/191283 A2 | 12/2016 |
| WO | 2016/210373 A2 | 12/2016 |
| WO | 2017/123675 A1 | 7/2017 |
| WO | 2018/129404 A1 | 7/2018 |
| WO | 2020/097424 A1 | 5/2020 |

OTHER PUBLICATIONS

U.S. Appl. No. 16/069,220, filed Jul. 11, 2018, 2019-0160115, Published.
U.S. Appl. No. 17/291,313, filed May 5, 2021, Pending.
Nyyssola et al., Production of xylitol from D-xylose by recombinant Lactococcus lactis. J Biotechnol. Jul. 21, 2005;118(1):55-66.
International Preliminary Report on Patentability for Application No. PCT/US2018/012698, dated Jul. 18, 2019, 14 pages.
International Search Report and Written Opinion for Application No. PCT/US2017/013072, dated May 19, 2017, 19 pages.
International Search Report and Written Opinion for Application No. PCT/US2018/012698, dated Jun. 5, 2018, 22 pages.
International Search Report and Written Opinion for Application No. PCT/US2018/041705, dated Dec. 6, 2018, 24 pages.
Invitation to Pay Additional Fees for Application No. PCT/US2018/012698, dated Apr. 9, 2018, 18 pages.
Invitation to Pay Additional Fees for Application No. PCT/US2018/041705, dated Sep. 24, 2018, 16 pages.
Written Opinion for Application No. PCT/US2015/047475, dated Feb. 2, 2016, 6 pages.
Agorio et al., Live attenuated Salmonella as a vector for oral cytokine gene therapy in melanoma. J Gene Med. May 2007;9(5):416-23.
Arrach et al., Salmonella promoters preferentially activated inside tumors. Cancer Res. Jun. 15, 2008;68(12):4827-32.
Becker et al., Exploitation of prokaryotic expression systems based on the salicylate-dependent control circuit encompassing nahR/P(sal)-xylS2 for biotechnological applications Bioeng Bugs Jul.-Aug. 2010;1(4):244-51.
Brader et al., Escherichia coli Nissle 1917 facilitates tumor detection by positron emission tomography and optical imaging. Clin Cancer Res. Apr. 15, 2008;14(8):2295-302.
Chen et al., A targeted IL-15 fusion protein with potent anti-tumor activity. Cancer Biol Ther. 2015;16(9):1415-21.
Chen et al., Evaluation of combined vaccinia virus-mediated antitumor gene therapy with p53, IL-2, and IL-12 in a glioma model. Cancer Gene Ther. Nov. 2000;7(11):1437-47.
Chen et al., Oncology meets immunology: the cancer-immunity cycle. Immunity. Jul. 25, 2013;39(1):1-10.
Choi et al., Concurrent delivery of GM-CSF and B7-1 using an oncolytic adenovirus elicits potent antitumor effect. Gene Ther. Jul. 2006;13(13):1010-20.
Cronin et al., Bacterial vectors for imaging and cancer gene therapy: a review. Cancer Gene Ther. Nov. 2012;19(11):731-40.
Cronin et al., Bacterial-mediated knockdown of tumor resistance to an oncolytic virus enhances therapy. Mol Ther. Jun. 2014;22(6):1188-1197.
Danino et al., Programmable probiotics for detection of cancer in urine. Sci Transl Med. May 27, 2015;7(289):289ra84, 12 pages.
Datsenko et al., One-step inactivation of chromosomal genes in Escherichia coli K-12 using PCR products. Proc Natl Acad Sci U S A Jun. 6, 2000;97(12):6640-5.
Din et al., Synchronized cycles of bacterial lysis for in vivo delivery. Nature. 12 pages, pre-publication, (2016).
Durand et al., Reprogramming of anaerobic metabolism by the FnrS small RNA. Mol Microbiol. Mar. 2010;75(5):1215-31.
Eike et al., The Cytolytic Amphipathic beta(2,2)-Amino Acid LTX-401 Induces DAMP Release in Melanoma Cells and Causes Complete Regression of B16 Melanoma. PLoS One. Feb. 16, 2016;11(2):e0148980. 19 pages.
Eng et al., Ammonia derived from glutaminolysis is a diffusible regulator of autophagy. Sci Signal. Apr. 27, 2010;3(119):ra31. 10 pages.
European Medicines Agency, Assessment Report for Yervoy (ipilimumab), Procedure No. EMEA/H/002213. 71 pages, May 19, 2011.
Farber et al., Immunological memory: lessons from the past and a look to the future. Nat Rev Immunol. Feb. 2016;16(2):124-8.
Foote et al., A STING Agonist Given with OX40 Receptor and PD-L1 Modulators Primes Immunity and Reduces Tumor Growth in Tolerized Mice. Cancer Immunol Res. Jun. 2017;5(6):468-479.
Forbes, Engineering the perfect (bacterial) cancer therapy. Nat Rev Cancer. Nov. 2010;10(11):785-94.
Geiger et al., L-Arginine Modulates T Cell Metabolism and Enhances Survival and Anti-tumor Activity. Cell. Oct. 20, 2016;167(3):829-842.
Georgiou, A Therapeutic Enzyme for Highly Effective Immune Checkpoint Inhibition in Cancer. Slideshow, 19 pages, (2015).
Grosso et al., CTLA-4 blockade in tumor models: an overview of preclinical and translational research. Cancer Immunity. Jan. 22, 2013;13(5):1-14.
Hemminki et al., Enabling successful T-cell therapy of solid tumors with oncolytic adenoviruses armed with TNFa and IL-2. Annals of Oncology. Oct. 2016;27(Suppl 6), Abstract 1080P. 1 page.
Hill et al., Magnetic resonance imaging of tumors colonized with bacterial ferritin-expressing Escherichia coli. PLoS One. 2011;6(10):e25409. 9 pages.
Hoffman, Bacterial Therapy of Cancer, Methods and Protocols. Humana Press. 193 pages, (1984).
Knee et al., Rationale for anti-GITR cancer immunotherapy. Eur J Cancer. Nov. 2016;67:1-10.
Koshy et al., Liposomal Delivery Enhances Immune Activation by STING Agonists for Cancer Immunotherapy. Adv Biosyst. Feb. 2017;1(1-2). pii: 1600013.
Li et al., Promising Targets for Cancer Immunotherapy: TLRs, RLRs, and STING-Mediated Innate Immune Pathways. Int J Mol Sci. Feb. 14, 2017;18(2) pii: E404. 19 pages.
Loeffler et al., Attenuated Salmonella engineered to produce human cytokine LIGHT inhibit tumor growth. Proc Natl Acad Sci USA Jul. 31, 2007;104(31):12879-83.
Loeffler et al., Salmonella typhimurium engineered to produce CCL21 inhibit tumor growth. Cancer Immunol Immunother. May 2009;58(5):769-75.
Mangesha et al., Development of a flexible and potent hypoxia-inducible promoter for tumor-targeted gene expression in attenuated Salmonella. Cancer Biol Ther. Sep. 2006;5(9):1120-8.
Marabelle et al., Intratumoral immunization: a new paradigm for cancer therapy. Clin Cancer Res. Apr. 1, 2014;20(7):1747-56.
Mengesha et al., Development of a flexible and potent hypoxia-inducible promoter for tumor-targeted gene expression in attenuated Salmonella. Cancer Biol Ther. Sep. 2006;5(9):1120-8.
Piao et al., Enhancement of T-cell-mediated anti-tumour immunity via the ectopically expressed glucocorticoid-induced tumour necrosis factor receptor-related receptor ligand (GITRL) on tumours. Immunology. Aug. 2009;127(4):489-99.

(56) References Cited

OTHER PUBLICATIONS

Reichert, Antibodies to watch in 2016. MAbs. 2016;8(2):197-204.
Ryan et al., Bacterial delivery of a novel cytolysin to hypoxic areas of solid tumors. Gene Ther. Mar. 2009;16(3):329-39.
Sagiv-Barfi et al., Eradication of spontaneous malignancy by local immunotherapy. Sci Transl Med. Jan. 31, 2018;10(426). pii: eaan4488. 13 pages.
Sanmamed et al., Defining the optimal murine models to investigate immune checkpoint blockers and their combination with other immunotherapies. Ann Oncol. Jul. 2016;27(7):1190-8.
Spinelli et al., Metabolic recycling of ammonia via glutamate dehydrogenase supports breast cancer biomass. Science. 10.1126/science.aam9305, pre-publication. 12 pages, (2017).
Stritzker et al., Myristoylation negative msbB-mutants of probiotic *E. coli* Nissle 1917 retain tumor specific colonization properties but show less side effects in immunocompetent mice. Bioeng Bugs. Mar.-Apr. 2010;1(2):139-45.
Stritzker et al., nterobacterial tumor colonization in mice depends on bacterial metabolism and macrophages but is independent of chemotaxis and motility. Int J Med Microbiol Nov. 2010;300(7):449-56.
Stritzker et al., Tumor-specific colonization, tissue distribution, and gene induction by probiotic *Escherichia coli* Nissle 1917 in live mice Int J Med Microbiol. Jun. 2007;297(3):151-62.
Thorne, Adding STING to the Tale of Oncolytic Virotherapy. Trends Cancer. Feb. 1, 2016;2(2):67-68.
Van Der Woude et al., Migrating into the Tumor: a Roadmap for T Cells. Trends Cancer. Nov. 2017;3(11):797-808.
Van Pijkeren et al., A novel Listeria monocytogenes-based DNA delivery system for cancer gene therapy. Hum Gene Ther. Apr. 2010;21(4):405-16.
Vargas et al., Rationale for stimulator of interferon genes-targeted cancer immunotherapy. Eur J Cancer. Apr. 2017;75:86-97.
Vonderheide, The Immune Revolution: A Case for Priming, Not Checkpoint. Cancer Cell. Apr. 9, 2018;33(4):563-569.
Whatcott et al., Targeting the tumor microenvironment in cancer: why hyaluronidase deserves a second look. Cancer Discov. Sep. 2011;1(4):291-6.
Zhou et al., STING-mediated DNA sensing in cancer immunotherapy. Sci China Life Sci. Jun. 2017;60(6):563-574.
Drees et al., Soluble production of a biologically active single-chain antibody against murine PD-L1 in *Escherichia coli*. Protein Expr Purif. 2014;94:60-66.
Corrales et al., Direct Activation of STING in the Tumor Microenvironment Leads to Potent and Systemic Tumor Regression and Immunity. Cell Rep. May 19, 2015;11(7):1018-30.
Leventhal et al., Immunotherapy with engineered bacteria by targeting the STING pathway for anti-tumor immunity. Nat Commun. Jun. 1, 2020;11(1):2739.
Skrnjug et al., The mucosal adjuvant cyclic di-AMP exerts immune stimulatory effects on dendritic cells and macrophages. PLoS One. Apr. 22, 2014;9(4):e95728, 9 pages.
International Search Report and Written Opinion for Application No. PCT/US2022/012030, dated Mar. 24, 2022, 14 pages.

\* cited by examiner

Western blot – total cytosolic protein

Western blot 1  2  3

1: *E. coli* Nissle secreted CD40L$_1$ (47-260)  − 32 kDa
2: *E. coli* Nissle secreted CD40L$_2$ (112-260)  − 24 kDa
3: *E. coli* Nissle control FD6x2sirpα

FD6sirpαhIgG4

Target protein is ~ 56 kDa.

*Increase in activated C4 and CD8 T cells following SYN-STING injection*

*Lack of activation of Tregs after SYN-STING injection*

**p<0.008 vs Control or SYN

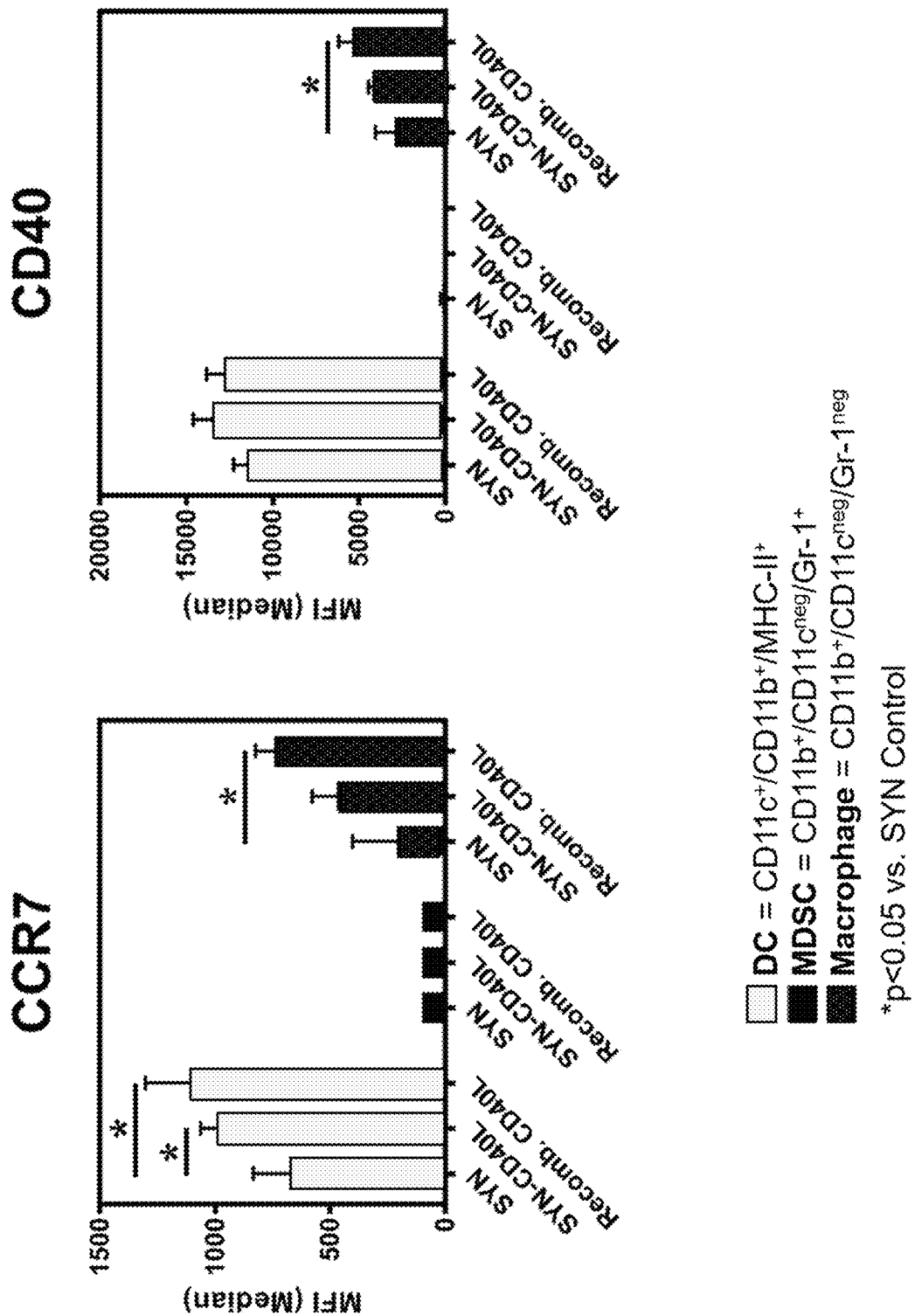

Tumor Colonization

TNFa Production

MICROORGANISMS PROGRAMMED TO PRODUCE IMMUNE MODULATORS AND ANTI-CANCER THERAPEUTICS IN TUMOR CELLS

RELATED APPLICATIONS

The instant application is a 35 U.S.C. § 371 national stage filing of International Application No. PCT/US2018/012698, filed on Jan. 5, 2018, which in turn claims priority to U.S. Provisional Application No. 62/443,634, filed on Jan. 6, 2017; and U.S. Provisional Application No. 62/443,639, filed on Jan. 6, 2017; is a continuation-in-part of PCT Application No. PCT/US2017/013072, filed on Jan. 11, 2017; claims priority to U.S. Provisional Application No. 62/531,784, filed on Jul. 12, 2017; U.S. Provisional Application No. 62/543,322, filed on Aug. 9, 2017; U.S. Provisional Application No. 62/552,319, filed on Aug. 30, 2017; U.S. Provisional Application No. 62/592,317, filed on Nov. 29, 2017; and U.S. Provisional Application No. 62/607,210, filed on Dec. 18, 2017; the entire contents of each of which are expressly incorporated herein by reference in their entireties.

SEQUENCE LISTING

The instant application contains a Sequence Listing which has been submitted electronically in ASCII format and is hereby incorporated by reference in its entirety. Said ASCII copy, created on Jan. 4, 2018, is named 126046_21320_SL.txt and is 1,278,036 bytes in size.

BACKGROUND OF THE INVENTION

Current cancer therapies typically employ the use of immunotherapy, surgery, chemotherapy, radiation therapy, or some combination thereof (American Cancer Society). While these drugs have shown great benefits to cancer patients, many cancers remain difficult to treat using conventional therapies. Currently, many conventional cancer therapies are administered systemically and adversely affect healthy tissues, resulting in significant side effects. For example, many cancer therapies focus on activating the immune system to boost the patient's anti-tumor response (Kong et al., 2014). However, despite such therapies, the microenvironment surrounding tumors remains highly immune suppressive. In addition, systemic altered immunoregulation provokes immune dysfunction, including the onset of opportunistic autoimmune disorders and immune-related adverse events.

Major efforts have been made over the past few decades to develop cytotoxic drugs that specifically target cancer cells. In recent years there has been a paradigm shift in oncology in which the clinical problem of cancer is considered not only to be the accumulation of genetic abnormalities in cancer cells but also the tolerance of these abnormal cells by the immune system. Consequently, recent anti-cancer therapies have been designed specifically to target the immune system rather than cancer cells. Such therapies aim to reverse the cancer immunotolerance and stimulate an effective antitumor immune response. For example, current immunotherapies include immunostimulatory molecules that are pattern recognition receptor (PRR) agonists or immunostimulatory monoclonal antibodies that target various immune cell populations that infiltrate the tumor microenvironment. However, despite their immune-targeted design, these therapies have been developed clinically as if they were conventional anticancer drugs, relying on systemic administration of the immunotherapeutic (e.g., intravenous infusions every 2-3 weeks). As a result, many current immunotherapies suffer from toxicity due to a high dosage requirement and also often result in an undesired autoimmune response or other immune-related adverse events.

Recent studies have suggested that the presence of certain types of gut microbes in mice can enhance the anti-tumor effects of cancer immunotherapy without increasing toxic side effects (M. Vétizou et al., "Anticancer immunotherapy by CTLA-4 blockade relies on the gut microbiota," Science, doi:10.1126/aad1329, 2015; A. Sivan et al., "Commensal *Bifidobacterium* promotes antitumor immunity and facilitates anti-PD-L1 efficacy," Science, doi:0.1126/science.aac4255, 2015). Whether the gut microbial species identified in these mouse studies will have the same effect in people is not clear.

Thus, there is an unmet need for effective cancer therapies that are able to target poorly vascularized, hypoxic tumor regions specifically target cancerous cells, while minimally affecting normal tissues and boost the immune systems to fight the tumors, including avoiding or reversing the cancer immunotolerance.

SUMMARY

The present disclosure provides compositions, methods, and uses of microorganisms that selectively target tumors and tumor cells and are able to produce one or more anti-cancer molecules, e.g., immune modulator(s), which are produced locally at the tumor site. In certain aspects, the present disclosure provides microorganisms, that are engineered to produce one or more anti-cancer molecule(s), e.g., immune modulators. Such engineered microorganisms can be targeted to cancer cells and/or tumor sites(s) for the selective delivery of gene circuits or cassettes comprising one or more anti-cancer molecules, to diseased tissue microenvironments in vivo. In certain aspects, the engineered microorganism is a bacteria, e.g., *Salmonella typhimurium, Escherichia coli* Nissle, *Clostridium novyi* NT, and *Clostridium butyricum* miyairi, as well as other exemplary bacterial strains provided herein, are able to selectively home to tumor microenvironments. Thus, in certain embodiments, the engineered microorganisms are administered systemically, e.g., via oral administration, intravenous injection, subcutaneous injection, or other means, and are able to selectively colonize a tumor site. For example, *E. coli* Nissle 1917 has been shown to selectively home into tumor tissue in rodent models of liver metastasis following oral delivery, but does not colonize healthy organs or fibrotic liver tissue. (Danino et al, 2015; Stritzker et al., Int J Med Micro, 297:151-162 (2007)). In other embodiments, the engineered microorganism, such as a bacteria or virus, are delivered locally (directly) to the tumor site or microenvironment, e.g., via intratumoral administration, such as intratumoral injection.

The present disclosure provides engineered microorganisms that selectively home to tumor microenvironments or that are administered locally to a tumor site, to deliver one or more anti-cancer molecules. Local delivery of an anti-cancer molecule, e.g., immunomodulatory agent, to the tumor microenvironment is advantageous because it allows a much higher concentration of the therapeutic agent (anti-cancer molecule(s)) to be delivered as compared with systemic delivery, which often results in autoimmune toxicity. Furthermore, recent evidence supports the idea that immunomodulatory agents, such as receptor agonists and immunostimulatory antibodies, delivered directly to a tumor, even at a single site, can generate a systemic or adaptive antitumor immune response by targeting immune cells present in the tumor microenvironment. Such immune cells include, for example, mature antigen-presenting cells, helper and effector cytotoxic T cells, tolergenic dendritic cells, tumor-associated macrophages and regulatory T cells, among other cell types, that infiltrate and/or surround the tumor site. Thus, in some aspects, the present disclosure provides microorganisms that selectively target tumor cells and are able to produce one or more anti-cancer molecules which are delivered locally to the tumor site to produce a local intratumoral immune response. This results in the induction of a tumor-selective adaptive immune response which is advantageous over other methods as it avoids generating an immune response to ato-antigens.

In certain aspects, the engineered microorganisms produce one or more anti-cancer molecules that target intratumoral immune cells (e.g., that infiltrate the tumor microenvironment). In certain embodiments, the anti-cancer molecule(s) produced by the engineered microorganism generates an innate antitumor immune response. In certain embodiments, the anti-cancer molecule(s) produced by the engineered microorganism generates a local antitumor immune response. In certain embodiments, the anti-cancer molecule(s) produced by the engineered microorganism generates a systemic or adaptive antitumor immune response. Examples of suitable anti-cancer molecules are described herein.

In addition to producing an anti-cancer molecule(s) that triggers an immune response, the engineered microorganisms themselves are advantageous in that they can generate an antitumor immune response, e.g., a local or innate immune response that develops into a systemic or adaptive immune response. For example, the engineered microorganism can stimulate the antigen-presenting ability of immune cells that infiltrate the tumor microenvironment (e.g., B cells, plasmacytoid and myeloid dendritic cells (DCs), CD4+ T cells, CD8+ T cells, Tregs, natural killer cells (NK cells), and tumor-associated macrophages (TAMs)). Many immune cells found in the tumor microenvironment express pattern recognition receptors (PRRs), which receptors play a key role in the innate immune response through the activation of pro-inflammatory signaling pathways, stimulation of phagocytic responses (macrophages, neutrophils and dendritic cells) or binding to micro-organisms as secreted proteins. PRRs recognize two classes of molecules: pathogen-associated molecular patterns (PAMPs), which are associated with microbial pathogens, and damage-associated molecular patterns (DAMPs), which are associated with cell components that are released during cell damage, death stress, or tissue injury. PAMPS are unique to each pathogen and are essential molecular structures required for the pathogens survival, e.g., bacterial cell wall molecules (e.g. lipoprotein), viral capsid proteins, and viral and bacterial DNA. PRRs can identify a variety of microbial pathogens, including bacteria, viruses, parasites, fungi, and protozoa. PRRs are primarily expressed by cells of the innate immune system, e.g., antigen presenting macrophage and dendritic cells, but can also be expressed by other cells (both immune and non-immune cells), and are either localized on the cell surface to detect extracellular pathogens or within the endosomes and cellular matrix where they detect intracellular invading viruses.

Examples of PRRs include Toll-like receptors (TLR), which are type 1 transmembrane receptors that have an extracellular domain which detects infecting pathogens. TLR1, 2, 4, and 6 recognize bacterial lipids, TLR3, 7 and 8 recognize viral RNA, TLR9 recognizes bacterial DNA, and TLR5 and 10 recognize bacterial or parasite proteins. (see Table 1 below, for examples of cells in the tumor microenvironment that express TLRs). Other examples of PRRs include C-type lectin receptors (CLR), e.g., group I mannose receptors and group II asialoglycoprotein receptors, cytoplasmic (intracellular) PRRs, nucleotide oligomerization (NOD)-like receptors (NLRs), e.g., NOD1 and NOD2, retinoic acid-inducible gene I (RIG-I)-like receptors (RLR), e.g., RIG-I, MDA5, and DDX3, and secreted PRRs, e.g., collectins, pentraxins, ficolins, lipid transferases, peptidoglycan recognition proteins (PGRs) and the leucine-rich repeat receptor (LRR).

Upon detection of a pathogen (e.g., stimulation by PAMP or DAMP), PRRs initiate the activation of signaling pathways, such as the NF-kappa B pathway, that stimulates the production of co-stimulatory molecules and pro-inflammatory cytokines, e.g., type I IFNs, IL-6, TNF, and IL-12, which mechanisms play a role in the activation of inflammatory and immune responses mounted against infectious pathogens. Such response triggers the activation of immune cells present in the tumor microenvironment that are involved in the adaptive immune response (e.g., antigen-presenting cells (APCs) such as B cells, DCs, TAMs, and other myeloid derived suppressor cells). Recent evidence indicates that immune mechanisms activated by PAMPs and DAMPs play a role in activating immune responses against tumor cells as well. For example, studies have shown that TLR activation of APCs within mice and in the human tumor microenvironment modifies their phenotype from tolergenic to immunogenic, with the up-regulation of class II MHC, CD80, and CD86, which activation is required to sustain the development of an efficient adaptive antitumor immune response. (LeMercier et al., Canc Res, 73:4629-40 (2013); Kim et al., Blood, 119:355-63 (2012)).

Furthermore, TLRs can also be expressed by tumor cells. The direct activation of TLRs on cancer cells can result in the death of the targeted tumor cell and/or up-regulate antigen presenting molecules, e.g., in the case of B-cell lymphomas, for example. Thus, upon chemotherapy, tumor-targeted therapy, or other therapy that causes tumor cell death, the tumor cells can release endogenous DAMPs, which are recognized by TLR or other PRR on tumor-infiltrating immune cells and cells surrounding the tumor cells, and activate an immune response. Such agonists (e.g., DAMPs) stimulate the antitumor response via activation of APCs infiltrating the tumor, effectively mounting an adaptive antitumor response against tumor-associated antigen.

Another PRR subfamily are the RIG-I-like receptors (RLRs) which are considered to be sensors of double-stranded viral RNA upon viral infection and which can be targeted for intratumoral immune stimulation. Upon stimulation, for example, upon intratumoral delivery of an oncolytic virus, RLRs trigger the release of type I IFNs by the host cell and result in its death by apoptosis. Such cytokine and tumor-associated antigen (TAA) release also results in the activation of the antitumor immune response. Given that RLRs are endogenously expressed in all tumor types, they are a universal proimmunogenic therapeutic target and of particular relevance in the immune response generated by local delivery of an oncolytic virus.

Tumor responses have long been observed upon intratumoral delivery of pathogens, such as microorganisms of the disclosure, and have been shown to provide therapeutic benefit in several types of cancers, including solid tumors, melanoma, basal cell carcinomas, and squamous cell carcinoma, which effects are, in part, due to the proinflammatory properties of the nucleic acid fractions, capsid proteins, and/or cell wall fractions of microorganisms that activate PRRs. For example, intratumoral injections of extracts from bacteria, *Streptococcus pneumoniae* and *Serratia marcescens*) have shown therapeutic effect for solid tumors. Intratumoral injections of *Bacillus* Calmette-Guerin (BCG) have shown therapeutic benefits to several different types of cancers, including melanoma and squamous cell carcinoma, due, in part, to the ability of BCG DNA and cell wall skeleton to activate PRRs (Morton et al, Ann Surg, 1974, 180:635-43; Melvin et al., JAMA, 1974, 229:688; Krown et al. m Cancer, 1978, 42:2648-60; Bier et al., Cancer Immunol, 1981, 12:71-79; Hortobagyi et al., Cancer, 1978, 42:2293-2303; Bast et al., N Engl J Med, 1974, 290:1458-69; Shimada et al., J Natl Cancer Inst, 1985, 74:681-8; Tokunaga et al., Jpn J Infect Dis, 1999, 52:1-11; Krieg et al., Nature, 1995, 374:546-9; Neville et al., Nat Clin Pract Oncol, 2007, 4: 462-9; Ryan et al., Bioessays. 2006 January; 28(1):84-94; Baban et al., Bioengineered Bugs 1:6, 385-394; November/December 2010).

Systemic immune effects have also been observed using oncolytic virus therapy, due, in part, to the ability of their viral DNA and/or their capsid proteins to act as PRR agonists. Intratumoral delivery of oncolytic viruses have been shown to generate a systemic antitumor immune response, for example, in liver cancer and hepatocellular carcinoma. Bowie et al., Nat rev Immunol, 2008, 8:911-22; Park et al., Lancet Oncol, 2008, 9:533-542; Heo et al., Nat Med, 2013, 19:329-36).

These approaches have several limitations that have hindered their broad applicability to treating cancer (Ryan et al., BioEssays 28:84-94, (2005). Use of bacteria in anti-cancer therapies; Nallar et al., Cytokine. 2016, Bacteria and genetically modified bacteria as cancer therapeutics: Current advances and challenges; Krzykawski C combined bacterial and viral treatment: a novel anticancer strategy, Cent Eur J Immunol. 2015; 40(3):366-72; Li et al., Live-Attenuated Bacterial Vectors: Tools for Vaccine and Therapeutic Agent Delivery. Vaccines (Basel). 2015 Nov. 10; 3(4):940-72). Most immunotherapies which include bacteria or viruses have also failed (Krzykawski, Centr Eur J Immunol 2015; 40 (3): 366-372). The pathogenic bacteria for instance can cause massive inflammatory response locally and systemically that can lead to significant adverse events, such as sepsis. It is also reported that growing tumor cannot develop healthy vasculature and without one, hypoxic regions appear. As a result of hypoxia and handicapped vascularization, many cells die leaving all the debris in the tumor causing adverse events (Krzykawski, Centr Eur J Immunol 2015; 40 (3): 366-372). Therefore, the bacteria of choice are suggested to be optional or obligatory anaerobes which will limit the spread of the bacteria mainly to the tumor tissue (Dang et al. 2001: Proc Natl Acad Sci USA 98: 15155-15160). Additionally, methods of precise delivery of the therapeutic bacteria to tumors with limited blood supply must be provided.

The microorganisms of the present disclosure, such as engineered non-pathogenic bacteria, can overcome some of the limitations of the earlier approaches by selectively and locally producing one or more anti-cancer molecules at the tumor site, and have the added advantage of being able to activate an intratumoral immune response. In some aspects, the microorganism is able to activate an innate or local immune response. In some aspects, the microorganism is able to activate APCs. In some aspects, the microorganism is able to activate systemic antitumor immunity against distant cancer cells. In some aspects, the microorganism is able to activate adaptive antitumor immunity.

In certain embodiments, the engineered microorganisms produce one or more anti-cancer molecules that target intratumoral immune cells (e.g., immune cells that infiltrate the tumor microenvironment). In certain embodiments, the anti-cancer molecules produced by the engineered microorganisms generate a local antitumor immune response. In certain embodiments, the anti-cancer molecules produced by the engineered microorganisms generate a systemic or adaptive antitumor immune response. In certain embodiments, the anti-cancer molecules produced by the engineered microorganisms generate a systemic or adaptive antitumor immune response against cancer cells distant to the local tumor site (site of intratumoral delivery or injection). In certain aspects, the engineered microorganisms produce one or more anti-cancer molecules that target tumor cells and activate a local and/or systemic immune response.

The specific tumor targeting abilities of systemically administered engineered microorganisms and/or the local (e.g., intratumoral) delivery of engineered microorganisms not only provide a local cytotoxic effect at the tumor site, but also provide a therapeutic systemic anti-tumor immune response (against distant cancers cells and/or uninjected tumor sites) with minimal autoimmune dysfunction or other adverse immune event. Local delivery or selective tumor targeting by the microorganisms prevents the circulation of high concentrations of immune modulators, e.g. immune stimulatory agents, in the blood. Moreover, local or selective tumor delivery of the microorganisms allows much higher concentrations of immunostimulatory agents in the tumor site needed to trigger the adaptive immune response.

In addition to the advantages associated with their ability to selectively target tumor cells (as a result of local delivery or the ability to home to a tumor site), resulting in the production of both a local and adaptive immune response, the engineered microorganisms have the advantage that they can be engineered to produce a combination of anti-cancer molecules, e.g., immune modulators. The engineered microorganisms have a further advantage in that they can be engineered to deliver more than one anti-cancer molecule selectively to the tumor site. For example, the engineered microorganisms can be engineered to produce anti-cancer molecules that, in combination, reverse cancer-induced immunotolerance and also trigger an effective anti-tumor immune response. For example, the engineered microorganisms can be engineered to produce a combination of anti-cancer molecules, one or more that may serve to reverse immune tolerance (or immune suppression) and one or more that may serve to activate antigen presentation and/or stimulate or activate an immune response. Moreover, these anti-cancer molecules can be regulated by an inducible-promoter that is induced in response to environmental conditions found in the tumor microenvironment, e.g., under hypoxic or low-oxygen conditions. This type of regulation further serves to ensure that the anti-cancer molecules are expressed at the tumor site and not expressed in normal or non-cancerous tissue.

Thus, in certain aspects, the engineered microorganisms of the present disclosure are engineered to produce one or more anti-cancer molecules that inhibit or suppress tumor immunotolerance in the tumor microenvironment. In certain aspects, the engineered microorganisms of the present disclosure are engineered to produce one or more anti-cancer molecules that activate or stimulate an antitumor immune response in the tumor microenvironment. In certain aspects, the engineered microorganisms of the present disclosure are engineered to produce one or more anti-cancer molecules that inhibit or suppress tumor immunotolerance and activate or stimulate an antitumor immune response in the tumor microenvironment. In some embodiments, the local suppression of tumor immunotolerance and immune stimulation leads to s systemic adaptive immune response.

Thus, in certain aspects, the engineered microorganisms of the present disclosure are engineered to produce one or more anti-cancer molecules that can either (1) inhibit or suppress or reverse tumor immunotolerance in the local tumor microenvironment, (2) activate or stimulate an antitumor immune response in the local tumor microenvironment, or (3) do both. In certain aspects, the engineered microorganisms of the present disclosure are engineered to produce one or more anti-cancer molecules that can either inhibit or suppress tumor immunotolerance. Examples of anti-cancer molecules that inhibit or suppress or reverse tumor immunotolerance in the local tumor microenvironment include, for example: (1) anti-cancer molecules that inhibit immune checkpoints; (2) anti-cancer molecules inhibit suppressive cytokines and/or chemokines; (3) anti-cancer molecules that inhibit phagocytosis escape; (4) anti-cancer molecules that decrease or deplete metabolites that contribute to immunosuppression; and (5) anti-cancer molecules that inhibit angiogenesis. Thus, the genetically engineered microorganisms of the present disclosure are engineered to produce one or more anti-cancer molecules selected from immune checkpoint inhibitors, inhibitors of suppressive cytokines and/or chemokines, inhibitors of molecules that assist in phagocytosis escape, molecules that decrease or deplete metabolites that contribute to immunosuppression, inhibitors of molecules that promote angiogenesis, and combinations thereof. Non-limiting examples of these molecules are described herein below.

In certain aspects, the engineered microorganisms of the present disclosure are engineered to produce one or more anti-cancer molecules that can activate or stimulate an antitumor immune response. Examples of anti-cancer molecules that activate or stimulate an antitumor immune response in the local tumor microenvironment include, for example: (1) immunostimulatory cytokines; (2) co-stimulation molecules that work with other immune molecules, e.g., immunostimulatory cytokines, to stimulate an immune response; (3) antibodies that promote immune engagement; (4) immune molecules involved in adoptive effector cell therapy; (5) tumor antigens that serve as vaccines, and (6) cytotoxins or lytic peptides. Thus, the genetically engineered microorganisms of the present disclosure are engineered to produce one or more anti-cancer molecules selected from immunostimulatory cytokines, co-stimulation molecules that work with other immune molecules to stimulate an immune response, antibodies that promote immune engagement, immune molecules involved in adoptive effector cell therapy, tumor antigens that serve as vaccines, cytotoxins or lytic peptides, and combinations thereof. Non-limiting examples of these molecules are described herein below.

In any of these embodiments, the engineered microorganism is an engineered bacterium. In any of these embodiments, the engineered microorganism is a tumor-targeting engineered bacterium. In some embodiments, the tumor-targeting engineered bacterium naturally homes to cancer cells and/or to a tumor site. In some embodiments, the tumor-targeting engineered bacterium is engineered to so that it targets cancer cells and/or to a tumor site, e.g., comprises non-native gene sequence(s) that provide tumor-targeting capability. In any of these embodiments, the engineered bacteria is engineered to produce one or more anti-cancer molecules that inhibit or suppress tumor immunotolerance and also to produce one or more anti-cancer molecules that activate or stimulate an antitumor immune response. In some embodiments, the engineered bacteria is engineered to produce one or more anti-cancer molecules under the control of a promoter that is activated by low-oxygen conditions. In some embodiments, the genetically engineered bacterium is a tumor-targeting bacterium that expresses one or more anti-cancer molecules under the control of a promoter that is activated by low-oxygen conditions. In certain embodiments, the genetically engineered bacteriaes express one or more anti-cancer molecules under the control of a promoter that is activated by hypoxic conditions, or by inflammatory conditions, such as any of the promoters activated by said conditions and described herein. In some embodiments, the genetically engineered bacteria express one or more anti-cancer molecules under the control of a cancer-specific promoter, a tissue-specific promoter, or a constitutive promoter, such as any of the promoters described herein.

In any of these embodiments, a combination of engineered bacteria can be used in conjunction with conventional cancer therapies, such as surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, therapy, and blood product donation and transfusion, and oncolytic viruses. In any of these embodiments, the engineered bacteria can produce one or more cytotoxins or lytic peptides. In any of these embodiments, the engineered bacteria can be used in conjunction with a cancer or tumor vaccine.

BRIEF DESCRIPTION OF THE FIGURES

FIG. 6A depicts a bar graph showing tryptophan production by various tryptophan producing strains. The data show expressing a feedback resistant form of AroG (AroG$^{fbr}$) is necessary to get tryptophan production. Additionally, using a feedback resistant trpE (trpE$^{fbr}$) has a positive effect on tryptophan production. FIG. 6B shows tryptophan production from a strain comprising a tet-trpE$^{fbr}$DCBA, tet-aroG$^{fbr}$ construct, comparing glucose and glucuronate as carbon sources in the presence and absence of oxygen. It takes *E. coli* two molecules of phosphoenolpyruvate (PEP) to produce one molecule of tryptophan. When glucose is used as the carbon source, 50% of all available PEP is used to import glucose into the cell through the PTS system (Phosphotransferase system). Tryptophan production is improved by using a non-PTS sugar (glucuronate) aerobically. The data also show the positive effect of deleting tnaA (only at early time point aerobically). FIG. 6C depicts a bar graph showing improved tryptophan production by engineered strain comprising ΔtrpRΔtnaA, tet-trpE$^{fbr}$DCBA, tet-aroG$^{fbr}$ through the addition of serine. FIG. 6D depicts a bar graph showing a comparison in tryptophan production in strains SYN2126, SYN2323, SYN2339, SYN2473, and SYN2476. SYN2126 ΔtrpRΔtnaA. ΔtrpRΔtnaA, tet-aroGfbr. SYN2339 comprises ΔtrpRΔtnaA, tet-aroGfbr, tet-trpEfbrDCBA. SYN2473 comprises ΔtrpRΔtnaA, tet-aroGfbr-serA, tet-trpEfbrDCBA. SYN2476 comprises ΔtrpRΔtnaA, tet-trpEfbrDCBA. Results indicate that expressing aroG is not sufficient nor necessary under these conditions to get Trp production and that expressing serA is beneficial for tryptophan production.

FIG. 10A depicts a dot plot showing a intra tumor concentrations observed for the kynurenine consuming strain SYN1704, carrying a constitutively expressed *Pseudomonase fluorescens* kynureninase on a medium copy plasmid. FIG. 10B. depicts a dot plot showing a intra tumor concentrations observed for the kynurenine consuming strain SYN2028 carrying a constitutively expressed chromosomally integrated copy of *Pseudomonase fluorescens* kynureninase. The IDO inhibitor INCB024360 is used as a positive control.

FIG. 13A depicts a bar graph of the levels of arginine production of SYN-UCD205, SYN-UCD206, and SYN-UCD301 measured at 0, 30, 60, and 120 minutes. FIG. 13B depicts a bar graph of the levels of arginine production of SYN-UCD204 (comprising ΔArgR, PfnrS-ArgAfbr on a low-copy plasmid and wild type ThyA), SYN-UCD301, SYN-UCD302, and SYN-UCD303 (all three of which comprise an integrated FNR-ArgAfbr construct; SYN UCD301 comprises ΔArgR, and wtThyA; SYN 303 comprises ΔArgR, and ΔThyA). Results indicate that chromosomal integration of FNR ArgA fbr results in similar levels of arginine production as seen with the low copy plasmid strains expressing the same construct.

FIG. 22B depicts a competition assay, in which extracts from a *E coli* Nissle strain secreting tet-inducible anti-PD1-scFv was incubated with various amounts of soluble PDL1 (0, 5, 10, and 30 ug) showing that PDL1 can dose-dependently compete with the binding of anti-PD1-scFv secreted from *E. coli* Nissle to PD1 on mouse EL4 cells. FIG. 22B shows the IgG control.

FIG. 33B shows a positive control with recombinant hyaluronidase. FIG. 33C shows hyaluronidase activity of SYN1557 (parental strain delta PAL), and SYN3369 expressing tetracycline inducible leech hyaluronidase.

FIGS. 39B, 39C, 39D, and 39E depict line graphs showing each individual mouse for the study shown in FIG. 39A. Kyn consumer SYN2028 in combination with anti-CTL-4 and anti-PD1 antibodies has improved anti-tumor activity in MC38 tumors (FIG. 39E) over vehicle (FIG. 39B), anti-CTLA4 and anti-PD1 antibodies alone (FIG. 39C), or SYN94 (streptomycin resistant E. coli Nissle) plus anti-CTLA4 and anti-PD1 antibodies (FIG. 39D); i.e., the kynurenine consumer has the ability to improve anti-CTLA-4/anti-PD1 antibody-mediated anti-tumor activity.

FIG. 51C depicts graphs showing the relative expression of CCR7 (left) or CD40 (right) as measured by median Mean Fluorescence Intensity (MFI) on the indicated immune cell populations for intratumoral lymphocytes isolated from CT26 tumors on day 8 measured via flow cytometry.

FIG. 54A depicts the total number of migrated cells. FIG. 54B depicts the Migration relative to no cytokine control.

DESCRIPTION OF THE EMBODIMENTS

Figure 1:
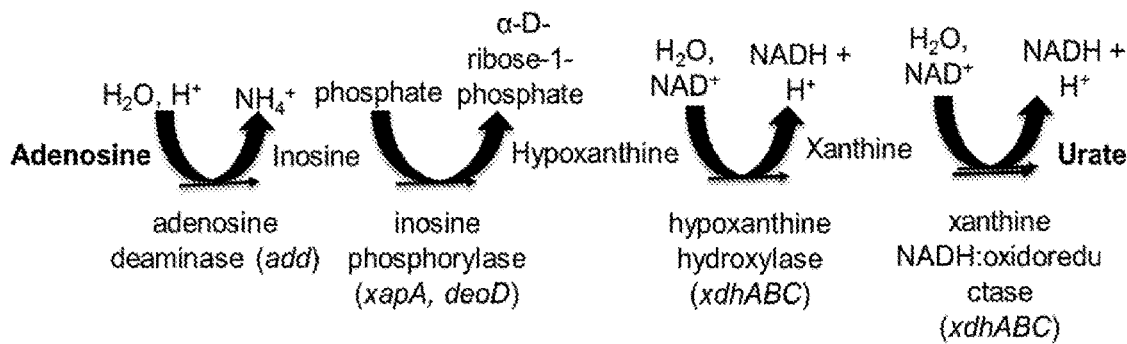
FIG. 1 depicts a schematic an adenosine degradation pathway and the corresponding bacterial pathway enzymes.

Certain tumors are particularly difficult to manage using conventional therapies. Hypoxia is a characteristic feature of solid tumors, wherein cancerous cells are present at very low oxygen concentrations. Regions of hypoxia often surround necrotic tissues and develop as solid forms of cancer outgrow their vasculature. When the vascular supply is unable to meet the metabolic demands of the tumor, the tumor's microenvironment becomes oxygen deficient. Multiple areas within tumors contain <1% oxygen, compared to 3-15% oxygen in normal tissues (Vaupel and Hockel, 1995), and avascular regions may constitute 25-75% of the tumor mass (Dang et al., 2001). Approximately 95% of tumors are hypoxic to some degree (Huang et al., 2004). Systemically delivered anticancer agents rely on tumor vasculature for delivery, however, poor vascularization impedes the oxygen supply to rapidly dividing cells, rendering them less sensitive to therapeutics targeting cellular proliferation in poorly vascularized, hypoxic tumor regions. Radiotherapy fails to kill hypoxic cells because oxygen is a required effector of radiation-induced cell death. Hypoxic cells are up to three times more resistant to radiation therapy than cells with normal oxygen levels (Bettegowda et al., 2003; Tiecher, 1995; Wachsberger et al., 2003). For all of these reasons, nonresectable, locally advanced tumors are particularly difficult to manage using conventional therapies.

In addition to the challenges associated with targeting a hypoxic environment, therapies that specifically target and destroy cancers must recognize differences between normal and malignant tissues, including genetic alterations and pathophysiological changes that lead to heterogeneous masses with areas of hypoxia and necrosis.

The invention includes genetically engineered microorganisms, e.g., genetically engineered bacteria, pharmaceutical compositions thereof, and methods of modulating or treating cancer. In certain embodiments, the genetically engineered bacteria are capable of targeting cancerous cells. In certain embodiments, the genetically engineered bacteria are capable of targeting cancerous cells, particularly in low-oxygen conditions, such as in hypoxic tumor environments. In certain embodiments, the genetically engineered bacteria are delivered locally to the tumor cells. In certain aspects, the compositions and methods disclosed herein may be used to deliver one or more anti-cancer molecules to cancerous cells or produce one or more anti-cancer molecules in cancerous cells.

This disclosure relates to compositions and therapeutic methods for the local and tumor-specific delivery of anti-cancer molecules in order to treat cancers. In certain aspects, the disclosure relates to genetically engineered microorganisms that are capable of targeting cancerous cells and producing one or more anti-cancer molecule(s), such as any of the anti-cancer molecules provided herein. In certain aspects, the disclosure relates to genetically engineered bacteria that are capable of targeting cancerous cells and producing one or more anti-cancer molecule(s). In certain aspects, the disclosure relates to genetically engineered bacteria that are capable of targeting cancerous cells, particularly in the hypoxic regions of a tumor, and producing one or more anti-cancer molecule(s) under the control of an oxygen level-inducible promoter. In contrast to existing conventional therapies, the hypoxic areas of tumors offer a perfect niche for the growth of anaerobic bacteria, the use of which offers an opportunity for eradication of advanced local tumors in a precise manner, sparing surrounding well-vascularized, normoxic tissue.

In some aspects, the disclosure provides a genetically engineered microorganism that is capable of delivering one or more anti-cancer molecules to tumor cells or the tumor microenvironment. In some aspects, the disclosure relates to a genetically engineered microorganism that is delivered systemically, e.g., via any of the delivery means described in the present disclosure, and are capable of producing one or more anti-cancer molecule(s), such as any of the anti-cancer molecules described in the present disclosure. In some aspects, the disclosure relates to a genetically engineered microorganism that is delivered locally, e.g., via local intra-tumoral administration, and are capable of producing one or more anti-cancer molecule(s), such as any of the anti-cancer molecules described in the present disclosure. In some aspects, the compositions and methods disclosed herein may be used to deliver one or more anti-cancer molecules selectively to tumor cells, thereby reducing systemic cytotoxicity or systemic immune dysfunction, e.g., the onset of an autoimmune event or other immune-related adverse event.

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

"Intratumoral administration" is meant to include any and all means for microorganism delivery to the intratumoral site and is not limited to intratumoral injection means. Examples of delivery means for the engineered microorganisms is discussed in detail herein.

"Cancer" or "cancerous" is used to refer to a physiological condition that is characterized by unregulated cell growth. In some embodiments, cancer refers to a tumor. "Tumor" is used to refer to any neoplastic cell growth or proliferation or any pre-cancerous or cancerous cell or tissue. A tumor may be malignant or benign. Types of cancer include, but are not limited to, adrenal cancer, adrenocortical carcinoma, anal cancer, appendix cancer, bile duct cancer, bladder cancer, bone cancer (e.g., Ewing sarcoma tumors, osteosarcoma, malignant fibrous histiocytoma), brain cancer (e.g., astrocytomas, brain stem glioma, craniopharyngioma, ependymoma), bronchial tumors, central nervous system tumors, breast cancer, Castleman disease, cervical cancer, colon cancer, rectal cancer, colorectal cancer, endometrial cancer, esophageal cancer, eye cancer, gallbladder cancer, gastrointestinal cancer, gastrointestinal carcinoid tumors, gastrointestinal stromal tumors, gestational trophoblastic disease, heart cancer, Kaposi sarcoma, kidney cancer, laryngeal cancer, hypopharyngeal cancer, leukemia (e.g., acute lymphoblastic leukemia, acute myeloid leukemia, chronic lymphocytic leukemia, chronic myelogenous leukemia), liver cancer, lung cancer, lymphoma (e.g., AIDS-related lymphoma, Burkitt lymphoma, cutaneous T cell lymphoma, Hodgkin lymphoma, Non-Hodgkin lymphoma, primary central nervous system lymphoma), malignant mesothelioma, multiple myeloma, myelodysplastic syndrome, nasal cavity cancer, paranasal sinus cancer, nasopharyngeal cancer, neuroblastoma, oral cavity cancer, oropharyngeal cancer, osteosarcoma, ovarian cancer, pancreatic cancer, penile cancer, pituitary tumors, prostate cancer, retinoblastoma, rhabdomyosarcoma, rhabdoid tumor, salivary gland cancer, sarcoma, skin cancer (e.g., basal cell carcinoma, melanoma), small intestine cancer, stomach cancer, teratoid tumor, testicular cancer, throat cancer, thymus cancer, thyroid cancer, unusual childhood cancers, urethral cancer, uterine cancer, uterine sarcoma, vaginal cancer, vulvar cancer, Waldenström macroglobulinemia, and Wilms tumor. Side effects of cancer treatment may include, but are not limited to, opportunistic autoimmune disorder(s), systemic toxicity, anemia, loss of appetite, irritation of bladder lining, bleeding and bruising (thrombocytopenia), changes in taste or smell, constipation, diarrhea, dry mouth, dysphagia, edema, fatigue, hair loss (alopecia), infection, infertility, lymphedema, mouth sores, nausea, pain, peripheral neuropathy, tooth decay, urinary tract infections, and/or problems with memory and concentration (National Cancer Institute).

As used herein, "abscopal" and "abscopal effect" refers to an effect in which localized treatment of a tumor not only shrinks or otherwise affects the tumor being treated, but also shrinks or otherwise affects other tumors outside the scope of the localized treatment. In some embodiments, the genetically engineered bacteria may elicit an abscopal effect. In some embodiments, no abscopal effect is observed upon administration of the genetically engineered bacteria.

"Hypoxia" is used to refer to reduced oxygen supply to a tissue as compared to physiological levels, thereby creating an oxygen-deficient environment. "Normoxia" refers to a physiological level of oxygen supply to a tissue. Hypoxia is a hallmark of solid tumors and characterized by regions of low oxygen and necrosis due to insufficient perfusion (Groot et al., 2007).

As used herein, "payload" refers to one or more molecules of interest to be produced by a genetically engineered microorganism, such as a bacteria or a virus. In some embodiments, the payload is a therapeutic payload, e.g., an anti-cancer molecule. In some embodiments, the payload is a regulatory molecule, e.g., a transcriptional regulator such as FNR. In some embodiments, the payload comprises a regulatory element, such as a promoter or a repressor. In some embodiments, the payload comprises an inducible promoter, such as from FNRS. In some embodiments, the payload comprises a repressor element, such as a kill switch. In some embodiments, the payload is encoded by a gene or multiple genes or an operon. In alternate embodiments, the payload is produced by a biosynthetic or biochemical pathway, wherein the biosynthetic or biochemical pathway may optionally be endogenous to the microorganism. In some embodiments, the genetically engineered microorganism comprises two or more payloads.

As used herein, the term "low oxygen" is meant to refer to a level, amount, or concentration of oxygen ($O_2$) that is lower than the level, amount, or concentration of oxygen that is present in the atmosphere (e.g., <21% $O_2$; <160 torr $O_2$)). Thus, the term "low oxygen condition or conditions" or "low oxygen environment" refers to conditions or environments containing lower levels of oxygen than are present in the atmosphere.

In some embodiments, the term "low oxygen" is meant to refer to the level, amount, or concentration of oxygen ($O_2$) found in a mammalian gut, e.g., lumen, stomach, small intestine, duodenum, jejunum, ileum, large intestine, cecum, colon, distal sigmoid colon, rectum, and anal canal. In some embodiments, the term "low oxygen" is meant to refer to a level, amount, or concentration of $O_2$ that is 0-60 mmHg $O_2$ (0-60 torr $O_2$) (e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, and 60 mmHg $O_2$), including any and all incremental fraction(s) thereof (e.g., 0.2 mmHg, 0.5 mmHg $O_2$, 0.75 mmHg $O_2$, 1.25 mmHg $O_2$, 2.175 mmHg $O_2$, 3.45 mmHg $O_2$, 3.75 mmHg $O_2$, 4.5 mmHg $O_2$, 6.8 mmHg $O_2$, 11.35 mmHg $O_2$, 46.3 mmHg $O_2$, 58.75 mmHg, etc., which exemplary fractions are listed here for illustrative purposes and not meant to be limiting in any way). In some embodiments, "low oxygen" refers to about 60 mmHg $O_2$ or less (e.g., 0 to about 60 mmHg $O_2$). The term "low oxygen" may also refer to a range of $O_2$ levels, amounts, or concentrations between 0-60 mmHg $O_2$ (inclusive), e.g., 0-5 mmHg $O_2$, <1.5 mmHg $O_2$, 6-10 mmHg, <8 mmHg, 47-60 mmHg, etc. which listed exemplary ranges are listed here for illustrative purposes and not meant to be limiting in any way. See, for example, Albenberg et al., Gastroenterology, 147(5): 1055-1063 (2014); Bergofsky et al., J Clin. Invest., 41(11): 1971-1980 (1962); Crompton et al., J Exp. Biol., 43: 473-478 (1965); He et al., PNAS (USA), 96: 4586-4591 (1999); McKeown, Br. J. Radiol., 87:20130676 (2014) (doi: 10.1259/brj.20130676), each of which discusses the oxygen levels found in the mammalian gut of various species and each of which are incorporated by reference herewith in their entireties.

In some embodiments, the term "low oxygen" is meant to refer to the level, amount, or concentration of oxygen ($O_2$) found in a mammalian organ or tissue other than the gut, e.g., urogenital tract, tumor tissue, etc. in which oxygen is present at a reduced level, e.g., at a hypoxic or anoxic level. In some embodiments, "low oxygen" is meant to refer to the level, amount, or concentration of oxygen ($O_2$) present in partially aerobic, semi aerobic, microaerobic, nonaerobic, microoxic, hypoxic, anoxic, and/or anaerobic conditions. For example, Table 1 summarizes the amount of oxygen present in various organs and tissues. In some embodiments, the level, amount, or concentration of oxygen ($O_2$) is expressed as the amount of dissolved oxygen ("DO") which refers to the level of free, non-compound oxygen ($O_2$) present in liquids and is typically reported in milligrams per liter (mg/L), parts per million (ppm; 1 mg/L=1 ppm), or in micromoles (umole) (1 umole $O_2$=0.022391 mg/L $O_2$). Fondriest Environmental, Inc., "Dissolved Oxygen", Fundamentals of Environmental Measurements, 19 Nov. 2013, www.fondriest.com/environmental-measurements/parameters/water-quality/dissolved-oxygen/>.

In some embodiments, the term "low oxygen" is meant to refer to a level, amount, or concentration of oxygen ($O_2$) that is about 6.0 mg/L DO or less, e.g., 6.0 mg/L, 5.0 mg/L, 4.0 mg/L, 3.0 mg/L, 2.0 mg/L, 1.0 mg/L, or 0 mg/L, and any fraction therein, e.g., 3.25 mg/L, 2.5 mg/L, 1.75 mg/L, 1.5 mg/L, 1.25 mg/L, 0.9 mg/L, 0.8 mg/L, 0.7 mg/L, 0.6 mg/L, 0.5 mg/L, 0.4 mg/L, 0.3 mg/L, 0.2 mg/L and 0.1 mg/L DO, which exemplary fractions are listed here for illustrative purposes and not meant to be limiting in any way. The level of oxygen in a liquid or solution may also be reported as a percentage of air saturation or as a percentage of oxygen saturation (the ratio of the concentration of dissolved oxygen ($O_2$) in the solution to the maximum amount of oxygen that will dissolve in the solution at a certain temperature, pressure, and salinity under stable equilibrium). Well-aerated solutions (e.g., solutions subjected to mixing and/or stirring) without oxygen producers or consumers are 100% air saturated.

In some embodiments, the term "low oxygen" is meant to refer to 40% air saturation or less, e.g., 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, 1%, and 0% air saturation, including any and all incremental fraction(s) thereof (e.g., 30.25%, 22.70%, 15.5%, 7.7%, 5.0%, 2.8%, 2.0%, 1.65%, 1.0%, 0.9%, 0.8%, 0.75%, 0.68%, 0.5%. 0.44%, 0.3%, 0.25%, 0.2%, 0.1%, 0.08%, 0.075%, 0.058%, 0.04%. 0.032%, 0.025%, 0.01%, etc.) and any range of air saturation levels between 0-40%, inclusive (e.g., 0-5%, 0.05-0.1%, 0.1-0.2%, 0.1-0.5%, 0.5-2.0%, 0-10%, 5-10%, 10-15%, 15-20%, 20-25%, 25-30%, etc.).

The exemplary fractions and ranges listed here are for illustrative purposes and not meant to be limiting in any way. In some embodiments, the term "low oxygen" is meant to refer to 9% $O_2$ saturation or less, e.g., 9%, 8%, 7%, 6%, 5%, 4%, 3%, 2%, 1%, 0%, 02 saturation, including any and all incremental fraction(s) thereof (e.g., 6.5%, 5.0%, 2.2%, 1.7%, 1.4%, 0.9%, 0.8%, 0.75%, 0.68%, 0.5%. 0.44%, 0.3%, 0.25%, 0.2%, 0.1%, 0.08%, 0.075%, 0.058%, 0.04%. 0.032%, 0.025%, 0.01%, etc.) and any range of $O_2$ saturation levels between 0-9%, inclusive (e.g., 0-5%, 0.05-0.1%, 0.1-0.2%, 0.1-0.5%, 0.5-2.0%, 0-8%, 5-7%, 0.3-4.2% $O_2$, etc.). The exemplary fractions and ranges listed here are for illustrative purposes and not meant to be limiting in any way.

TABLE 1

| Compartment | Oxygen Tension |
| --- | --- |
| stomach | ~60 torr (e.g., 58 +/− 15 torr) |
| duodenum and first part of jejunum | ~30 torr (e.g., 32 +/− 8 torr); ~20% oxygen in ambient air |
| Ileum (mid- small intestine) | ~10 torr; ~6% oxygen in ambient air (e.g., 11 +/− 3 torr) |
| Distal sigmoid colon | ~3 torr (e.g., 3 +/− 1 torr) |
| colon | <2 torr |
| Lumen of cecum | <1 torr |
| tumor | <32 torr (most tumors are <15 torr) |

As used herein, the term "gene" or "gene sequence" refers to any sequence expressing a polypeptide or protein, including genomic sequences, cDNA sequences, naturally occurring sequences, artificial sequences, and codon optimized sequences. The term "gene" or "gene sequence" inter alia includes includes modification of endogenous genes, such as deletions, mutations, and expression of native and non-native genes under the control of a promoter that that they are not normally associated with in nature.

As used herein the terms "gene cassette" and "circuit" "gene cassette" and "circuit" inter alia refers to any sequence expressing a polypeptide or protein, including genomic sequences, cDNA sequences, naturally occurring sequences, artificial sequences, and codon optimized sequences includes modification of endogenous genes, such as deletions, mutations, and expression of native and non-native genes under the control of a promoter that that they are not normally associated with in nature.

An "anti-cancer molecule" refers to one or more therapeutic substances or drugs of interest to be produced by a genetically engineered microorganism, e.g., engineered bacteria, which are capable of reducing and/or inhibiting cell growth or replication. In some embodiments, the anti-cancer molecule is a therapeutic molecule that is useful for modulating or treating a cancer. In some embodiments, the anti-cancer molecule is a therapeutic molecule encoded by a gene. In alternate embodiments, the anti-cancer molecule is a therapeutic molecule produced by a biochemical or biosynthetic pathway, wherein the biosynthetic or biochemical pathway may optionally be endogenous to the microorganism. In some embodiments, the genetically engineered microorganism is capable of producing two or more anti-cancer molecules. Non-limiting examples of anti-cancer molecules include immune checkpoint inhibitors (e.g., CTLA-4 antibodies, PD-1 antibodies, PDL-1 antibodies), cytotoxic agents (e.g., Cly A, FASL, TRAIL, TNF-alpha), immunostimulatory cytokines and co-stimulatory molecules (e.g., OX40, CD28, ICOS, CCL21, IL-2, IL-18, IL-15, IL-12, IFN-gamma, IL-21, TNFs, GM-CSF), antigens and antibodies (e.g., tumor antigens, neoantigens, CtxB-PSA fusion protein, CPV-OmpA fusion protein, NY-ESO-1 tumor antigen, RAF1, antibodies against immune suppressor molecules, anti-VEGF, Anti-CXR4/CXCL12, anti-GLP1, anti-GLP2, anti-galectinl, anti-galectin3, anti-Tie2, anti-CD47, antibodies against immune checkpoints, antibodies against immunosuppressive cytokines and chemokines), DNA transfer vectors (e.g., endostatin, thrombospondin-1, TRAIL, SMAC, Stat3, Bcl2, FLT3L, GM-CSF, IL-12, AFP, VEGFR2), and enzymes (e.g., *E. coli* CD, HSV-TK). In some embodiments, the anti-cancer molecule includes nucleic acid molecules that mediate RNA interference, microRNA response or inhibition, TLR response, antisense gene regulation, target protein binding (aptamer or decoy oligos), gene editing, such as CRISPR interference. In some embodiments, bacteria or virus can be used as vectors to transfer DNA into mammalian cells, e.g., by bactofection (Bernardes et al., 2013). Other anti-cancer molecules are described and listed herein.

An antibody generally refers to a polypeptide of the immunoglobulin family or a polypeptide comprising fragments of an immunoglobulin that is capable of noncovalently, reversibly, and in a specific manner binding a corresponding antigen. An exemplary antibody structural unit comprises a tetramer. Each tetramer is composed of two identical pairs of polypeptide chains, each pair having one "light" (about 25 kD) and one "heavy" chain (about 50-70 kD), connected through a disulfide bond. The recognized immunoglobulin genes include the κ, λ, α, γ, δ, ε, and μ constant region genes, as well as the myriad immunoglobulin variable region genes. Light chains are classified as either κ or λ. Heavy chains are classified as γ, μ, α, δ, or ε, which in turn define the immunoglobulin classes, IgG, IgM, IgA, IgD, and IgE, respectively. The N-terminus of each chain defines a variable region of about 100 to 110 or more amino acids primarily responsible for antigen recognition. The terms variable light chain (VL) and variable heavy chain (VH) refer to these regions of light and heavy chains respectively.

As used herein, the term "antibody" or "antibodies" is meant to encompasses all variations of antibody and fragments thereof that possess one or more particular binding specificities. Thus, the term "antibody" or "antibodies" is meant to include full length antibodies, chimeric antibodies, humanized antibodies, single chain antibodies (ScFv, camelids), Fab, Fab', multimeric versions of these fragments (e.g., F(ab')2), single domain antibodies (sdAB, $V_HH$ fragments), heavy chain antibodies (HCAb), nanobodies, diabodies, and minibodies. Antibodies can have more than one binding specificity, e.g. be bispecific. The term "antibody" is also meant to include so-called antibody mimetics. Antibody mimetics refers to small molecules, e.g., 3-30 kDa, which can be single amino acid chain molecules, which can specifically bind antigens but do not have an antibody-related structure. Antibody mimetics, include, but are not limited to, Affibody molecules (Z domain of Protein A), Affilins (Gamma-B crystalline), Ubiquitin, Affimers (Cystatin), Affitins (Sac7d (from *Sulfolobus acidocaldarius*), Alpha bodies (Triple helix coiled coil), Anticalins (Lipocalins), Avimers (domains of various membrane receptors), DARPins (Ankyrin repeat motif), Fynomers (SH3 domain of Fyn), Kunitz domain peptides Kunitz domains of various protease inhibitors), Ecallantide (Kalbitor), and Monobodies. In certain aspects, the term "antibody" or "antibodies" is meant to refer to a single chain antibody(ies), single domain antibody(ies), and camelid antibody(ies). Utility of antibodies in the treatment of cancer and additional anti-cancer antibodies can for example be found in Scott et al., Antibody Therapy for Cancer, Nature Reviews Cancer April 2012 Volume 12, incorporated by reference in its entirety.

A "single-chain antibody" or "single-chain antibodies" typically refers to a peptide comprising a heavy chain of an immunoglobulin, a light chain of an immunoglobulin, and optionally a linker or bond, such as a disulfide bond. The single-chain antibody lacks the constant Fc region found in traditional antibodies. In some embodiments, the single-chain antibody is a naturally occurring single-chain antibody, e.g., a camelid antibody. In some embodiments, the single-chain antibody is a synthetic, engineered, or modified single-chain antibody. In some embodiments, the single-chain antibody is capable of retaining substantially the same antigen specificity as compared to the original immunoglobulin despite the addition of a linker and the removal of the constant regions. In some aspects, the single chain antibody can be a "scFv antibody", which refers to a fusion protein of the variable regions of the heavy (VH) and light chains (VL) of immunoglobulins (without any constant regions), optionally connected with a short linker peptide of ten to about 25 amino acids, as described, for example, in U.S. Pat. No. 4,946,778, the contents of which is herein incorporated by reference in its entirety. The Fv fragment is the smallest fragment that holds a binding site of an antibody, which binding site may, in some aspects, maintain the specificity of the original antibody. Techniques for the production of single chain antibodies are described in U.S. Pat. No. 4,946,778. The Vh and VL sequences of the scFv can be connected via the N-terminus of the VH connecting to the C-terminus of the VL or via the C-terminus of the VH connecting to the N-terminus of the VL. ScFv fragments are independent folding entities that can be fused indistinctively on either end to other epitope tags or protein domains. Linkers of varying length can be used to link the Vh and VL sequences, which the linkers can be glycine rich (provides flexibility) and serine or threonine rich (increases solubility). Short linkers may prevent association of the two domains and can result in multimers (diabodies, tribodies, etc.). Long linkers may result in proteolysis or weak domain association (described in Voelkel et al el., 2011). Linkers of length between 15 and 20 amino acids or 18 and 20 amino acids are most often used. Additional non-limiting examples of linkers, including other flexible linkers are described in Chen et al., 2013 (Adv Drug Deliv Rev. 2013 Oct. 15; 65(10): 1357-1369.Fusion Protein Linkers: Property, Design and Functionality), the contents of which is herein incorporated by reference in its entirety. Flexible linkers are also rich in small or polar amino acids such as Glycine and Serine, but can contain additional amino acids such as Threonine and Alanine to maintain flexibility, as well as polar amino acids such as Lysine and Glutamate to improve solubility. Exemplary linkers include, but are not limited to, ", KESGSVSSEQLAQFRSLD (SEQ ID NO: 1238) and EGKSSGSGSESKST (SEQ ID NO: 1239), (Gly)8 (SEQ ID NO: 1240), and Gly and Ser rich flexible linker, GSAGSAAGSGEF (SEQ ID NO: 1241). "Single chain antibodies" as used herein also include single-domain antibodies, which include camelid antibodies and other heavy chain antibodies, light chain antibodies, including nanobodies and single domains VH or VL domains derived from human, mouse or other species. Single domain antibodies may be derived from any species including, but not limited to mouse, human, camel, llama, fish, shark, goat, rabbit, and bovine. Single domain antibodies include domain antigen-binding units which have a camelid scaffold, derived from camels, llamas, or alpacas. Camelids produce functional antibodies devoid of light chains. The heavy chain variable (VH) domain folds autonomously and functions independently as an antigen-binding unit. Its binding surface involves only three CDRs as compared to the six CDRs in classical antigen-binding molecules (Fabs) or single chain variable fragments (scFvs). Camelid antibodies are capable of attaining binding affinities comparable to those of conventional antibodies. Camelid scaffold-based antibodies can be produced using methods well known in the art. Cartilaginous fishes also have heavy-chain antibodies (IgNAR, 'immunoglobulin new antigen receptor'), from which single-domain antibodies called VNAR fragments can be obtained. Alternatively, the dimeric variable domains from IgG from humans or mice can be split into monomers. Nanobodies are single chain antibodies derived from light chains. The term "single chain antibody" also refers to antibody mimetics.

In some embodiments, the antibodies expressed by the engineered microorganisms are bispecific. In certain embodiments, a bispecific antibody molecule comprises a scFv, or fragment thereof, have binding specificity for a first epitope and a scFv, or fragment thereof, have binding specificity for a second epitope. Antigen-binding fragments or antibody portions include bivalent scFv (diabody), bispecific scFv antibodies where the antibody molecule recognizes two different epitopes, single binding domains (dAbs), and minibodies. Monomeric single-chain diabodies (scDb) are readily assembled in bacterial and mammalian cells and show improved stability under physiological conditions (Voelkel et al., 2001 and references therein; Protein Eng. (2001) 14 (10): 815-823 (describes optimized linker sequences for the expression of monomeric and dimeric bispecific single-chain diabodies).

As used herein, the term "polypeptide" includes "polypeptide" as well as "polypeptides," and refers to a molecule composed of amino acid monomers linearly linked by amide bonds (i.e., peptide bonds). The term "polypeptide" refers to any chain or chains of two or more amino acids, and does not refer to a specific length of the product. Thus, "peptides," "dipeptides," "tripeptides," "oligopeptides," "protein," "amino acid chain," or any other term used to refer to a chain or chains of two or more amino acids, are included within the definition of "polypeptide," and the term "polypeptide" may be used instead of, or interchangeably with any of these terms. The term "polypeptide" is also intended to refer to the products of post-expression modifications of the polypeptide, including but not limited to glycosylation, acetylation, phosphorylation, amidation, derivatization, proteolytic cleavage, or modification by non-naturally occurring amino acids. A polypeptide may be derived from a natural biological source or produced by recombinant technology. In other embodiments, the polypeptide is produced by the genetically engineered bacteria of the current invention. A polypeptide of the invention may be of a size of about 3 or more, 5 or more, 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides, which do not possess a defined three-dimensional structure, but rather can adopt a large number of different conformations, are referred to as unfolded.

An "isolated" polypeptide or a fragment, variant, or derivative thereof refers to a polypeptide that is not in its natural milieu. No particular level of purification is required. Recombinantly produced polypeptides and proteins expressed in host cells, including but not limited to bacterial or mammalian cells, are considered isolated for purposed of the invention, as are native or recombinant polypeptides which have been separated, fractionated, or partially or substantially purified by any suitable technique. Recombinant peptides, polypeptides or proteins refer to peptides, polypeptides or proteins produced by recombinant DNA techniques, i.e. produced from cells, microbial or mammalian, transformed by an exogenous recombinant DNA expression construct encoding the polypeptide. Proteins or peptides expressed in most bacterial cultures will typically be free of glycan. Fragments, derivatives, analogs or variants of the foregoing polypeptides, and any combination thereof are also included as polypeptides. The terms "fragment," "variant," "derivative" and "analog" include polypeptides having an amino acid sequence sufficiently similar to the amino acid sequence of the original peptide and include any polypeptides, which retain at least one or more properties of the corresponding original polypeptide. Fragments of polypeptides of the present invention include proteolytic fragments, as well as deletion fragments. Fragments also include specific antibody or bioactive fragments or immunologically active fragments derived from any polypeptides described herein. Variants may occur naturally or be non-naturally occurring. Non-naturally occurring variants may be produced using mutagenesis methods known in the art. Variant polypeptides may comprise conservative or non-conservative amino acid substitutions, deletions or additions.

Polypeptides also include fusion proteins. As used herein, the term "variant" includes a fusion protein, which comprises a sequence of the original peptide or sufficiently similar to the original peptide. As used herein, the term "fusion protein" refers to a chimeric protein comprising amino acid sequences of two or more different proteins. Typically, fusion proteins result from well known in vitro recombination techniques. Fusion proteins may have a similar structural function (but not necessarily to the same extent), and/or similar regulatory function (but not necessarily to the same extent), and/or similar biochemical function (but not necessarily to the same extent) and/or immunological activity (but not necessarily to the same extent) as the individual original proteins which are the components of the fusion proteins. "Derivatives" include but are not limited to peptides, which contain one or more naturally occurring amino acid derivatives of the twenty standard amino acids. "Similarity" between two peptides is determined by comparing the amino acid sequence of one peptide to the sequence of a second peptide. An amino acid of one peptide is similar to the corresponding amino acid of a second peptide if it is identical or a conservative amino acid substitution. Conservative substitutions include those described in Dayhoff, M. O., ed., The Atlas of Protein Sequence and Structure 5, National Biomedical Research Foundation, Washington, D.C. (1978), and in Argos, EMBO J. 8 (1989), 779-785. For example, amino acids belonging to one of the following groups represent conservative changes or substitutions: -Ala, Pro, Gly, Gln, Asn, Ser, Thr; -Cys, Ser, Tyr, Thr; -Val, Ile, Leu, Met, Ala, Phe; -Lys, Arg, His; -Phe, Tyr, Trp, His; and -Asp, Glu.

In any of these combination embodiments, the genetically engineered bacteria may comprise gene sequence(s) encoding one or more fusion proteins. In some embodiments, the genetically engineered bacteria comprise gene sequence(s) encoding an effector or anti-cancer molecule fused to a stabilizing polypeptide. Such stabilizing polypeptides are known in the art and include Fc proteins. In some embodiments, the fusion proteins encoded by the genetically engineered bacteria are Fc fusion proteins, such as IgG Fc fusion proteins or IgA Fc fusion proteins.

In some embodiments, anti-cancer molecule is covalently fused to the stabilizing polypeptide through a peptide linker or a peptide bond. In some embodiments, the anti-cancer molecule is covalently fused to the stabilizing polypeptide through a peptide linker or a peptide bond. In some embodiments, the C terminus of the anti-cancer molecule is covalently fused to the N terminus of the stabilizing polypeptide through the peptide linker or peptide bond. In some embodiments, the N terminus of the anti-cancer molecule is covalently fused to the C terminus of the stabilizing polypeptide through the peptide linker or peptide bond. In some embodiments, the stabilizing polypeptide comprises an immunoglobulin Fc polypeptide. In some embodiments, the immunoglobulin Fc polypeptide comprises at least a portion of an immunoglobulin heavy chain CH2 constant region. In some embodiments, the immunoglobulin Fc polypeptide comprises at least a portion of an immunoglobulin heavy chain CH3 constant region. In some embodiments, the immunoglobulin Fc polypeptide comprises at least a portion of an immunoglobulin heavy chain CH1 constant region. In some embodiments, the immunoglobulin Fc polypeptide comprises at least a portion of an immunoglobulin variable hinge region. In some embodiments, the immunoglobulin Fc polypeptide comprises at least a portion of an immunoglobulin variable hinge region, immunoglobulin heavy chain CH2 constant region and an immunoglobulin heavy chain CH3 constant region. The genetically engineered bacterium of any of claims 2-64, and any of claims 112-122, wherein the immunoglobulin Fc polypeptide is a human IgG Fc polypeptide. In some embodiments, the immunoglobulin Fc polypeptide is a human IgG4 Fc polypeptide. In some embodiments, the linker comprises a glycine rich peptide. In some embodiments, the glycine rich peptide comprises the sequence [GlyGlyGlyGlySer]n where n is 1, 2, 3, 4, 5 or 6 (SEQ ID NO: 1242). In some embodiments, the fusion protein comprises a SIRPalpha IgG FC fusion polypeptide. In some embodiments, the fusion protein comprises a SIRPalpha IgG4 Fc polypeptide. In some embodiments, the glycine rich peptide linker comprises the sequence SGGGGSGGGGSGGGGS (SEQ ID NO: 1243). In some embodiments, the N terminus of SIRPalpha is covalently fused to the C terminus of a IgG4 Fc through the peptide linker comprising SGGGGSGGGGSGGGGS (SEQ ID NO: 1243).

In some embodiments, the genetically engineered bacteria comprise one or more gene sequences encoding components of a multimeric polypeptide. In some embodiments, the polypeptide is a dimer. Non-limiting example of a dimeric proteins include cytokines, such as IL-15 (heterodimer). In some embodiments, genetically engineered bacteria comprise one or more gene(s) encoding one or more polypeptides wherein the one or more polypeptides comprise a first monomer and a second monomer. In some embodiments, the first monomer polypeptide is covalently linked to a second monomer polypeptide through a peptide linker or a peptide bond. In some embodiments, the linker comprises a glycine rich peptide. In some embodiments, the first and the second monomer have the same polypeptide sequence. In some embodiments, the first and the second monomer have each have a different polypeptide sequence. In some embodiments, the first monomer is a IL-12 p35 polypeptide and the second monomer is a IL-12 p40 polypeptide. In some embodiments, the linker comprises GGGGSGGGS (SEQ ID NO: 1244).

In some embodiments, the genetically engineered bacteria encode a hIGg4 fusion protein which comprises a hIgG4 portion that has about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 1117. In another embodiment, the hIgG4 portion comprises SEQ ID NO: 1117. In yet another embodiment, the hIgG4 portion of the polypeptide expressed by the genetically engineered bacteria consists of SEQ ID NO: 1117.

In some embodiments, the nucleic acid encoding a fusion protein, such as an hIGg4 fusion protein, comprises a sequence which has at least about 80%, at least about 85%, at least about 90%, at least about 95%, or at least about 99% homology to a SEQ ID NO: 1103. In some embodiments, the nucleic acid encoding a fusion protein, comprises SEQ ID NO: 1103. In some embodiments, nucleci acid portion encoding hIgG4 consists of a SEQ ID NO: 1103. In some embodiments, the genetically engineered bacteria encode a fusion protein which comprises a linker portion that has about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 1121. In another embodiment, the linker portion comprises SEQ ID NO: 1121. In yet another embodiment, the linker portion of the polypeptide expressed by the genetically engineered bacteria consists of SEQ ID NO: 1121.

In some embodiments, effector function of an anti-cancer molecule can be improved through fusion to another polypeptide that facilitates effector function. A non-limiting example of such a fusion is the fusion of IL-15 to the Sushi domain of IL-15Ralpha, as described herein. In some embodiments, accordingly, a first monomer polypeptide is a IL-15 monomer and the second monomer is a IL-15R alpha sushi domain polypeptide.

In any of these embodiments and all combination embodiments, the genetically engineered bacteria comprise gene sequence(s) encoding one or more secretion tags described herein. In any of these embodiments, the genetically engineered bacteria comprise one or more mutations in an endogenous membrane associated protein allowing for the diffusible outer membrane phenotype. Suitable outer membrane mutations are described herein.

As used herein, the term "sufficiently similar" means a first amino acid sequence that contains a sufficient or minimum number of identical or equivalent amino acid residues relative to a second amino acid sequence such that the first and second amino acid sequences have a common structural domain and/or common functional activity. For example, amino acid sequences that comprise a common structural domain that is at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100%, identical are defined herein as sufficiently similar. Preferably, variants will be sufficiently similar to the amino acid sequence of the peptides of the invention. Such variants generally retain the functional activity of the peptides of the present invention. Variants include peptides that differ in amino acid sequence from the native and wt peptide, respectively, by way of one or more amino acid deletion(s), addition(s), and/or substitution(s). These may be naturally occurring variants as well as artificially designed ones.

As used herein the term "linker", "linker peptide" or "peptide linkers" or "linker" refers to synthetic or non-native or non-naturally-occurring amino acid sequences that connect or link two polypeptide sequences, e.g., that link two polypeptide domains. As used herein the term "synthetic" refers to amino acid sequences that are not naturally occurring. Exemplary linkers are described herein. Additional exemplary linkers are provided in US 20140079701, the contents of which are herein incorporated by reference in its entirety. In some embodiments, the linker is a glycine rich linker. In some embodiments, the linker is (Gly-Gly-Gly-Gly-Ser)n (SEQ ID NO: 1245). In some embodiments, the linker comprises SEQ ID NO: 979.

As used herein the term "codon-optimized sequence" refers to a sequence, which was modified from an existing coding sequence, or designed, for example, to improve translation in an expression host cell or organism of a transcript RNA molecule transcribed from the coding sequence, or to improve transcription of a coding sequence. Codon optimization includes, but is not limited to, processes including selecting codons for the coding sequence to suit the codon preference of the expression host organism.

Many organisms display a bias or preference for use of particular codons to code for insertion of a particular amino acid in a growing polypeptide chain. Codon preference or codon bias, differences in codon usage between organisms, is allowed by the degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

As used herein, the terms "secretion system" or "secretion protein" refers to a native or non-native secretion mechanism capable of secreting or exporting the anti-cancer molecule from the microbial, e.g., bacterial cytoplasm. The secretion system may comprise a single protein or may comprise two or more proteins assembled in a complex e.g. HlyBD. Non-limiting examples of secretion systems for gram negative bacteria include the modified type III flagellar, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems. In some embodiments, the anti-cancer molecule(s) include a "secretion tag" of either RNA or peptide origin to direct the anti-cancer molecule(s) to specific secretion systems. In some embodiments, the secretion system is able to remove this tag before secreting the anti-cancer molecule from the engineered bacteria. For example, in Type V auto-secretion-mediated secretion the N-terminal peptide secretion tag is removed upon translocation of the "passenger" peptide from the cytoplasm into the periplasmic compartment by the native Sec system. Further, once the auto-secretor is translocated across the outer membrane the C-terminal secretion tag can be removed by either an autocatalytic or protease-catalyzed e.g., OmpT cleavage thereby releasing the anti-cancer molecule(s) into the extracellular milieu.

As used herein, the term "transporter" is meant to refer to a mechanism, e.g., protein or proteins, for importing a molecule into the microorganism from the extracellular milieu.

The immune system is typically divided into two categories—innate immunity and adaptive immunity—although the immune responses associated with these immunities are not mutually exclusive. "Innate immunity" refers to non-specific defense mechanisms that are activated immediately or within hours of a foreign agent's or antigen's appearance in the body. These mechanisms include physical barriers such as skin, chemicals in the blood, and immune system cells, such as dendritic cells (DCs), leukocytes, phagocytes, macrophages, neutrophils, and natural killer cells (NKs), that attack foreign agents or cells in the body. Also, during an innate immune response, cytokines are produced which activate the adaptive immune response. "Adaptive immunity" or "acquired immunity" refers to antigen-specific immune response and is more complex than the innate immune response. The antigen must first be processed or "presented" by antigen presenting cells (APCs). An antigen-presenting cell or accessory cell is a cell that displays antigen complexed with major histocompatibility complexes (MHCs) on their surfaces. Professional antigen-presenting cells, including macrophages, B cells, and dendritic cells, specialize in presenting foreign antigen to T helper cells, while other cell types can present antigen originating inside the cell to cytotoxic T cells. Once an antigen has been presented and recognized, the adaptive immune system activates an army of immune cells specifically designed to attack that antigen. Like the innate system, the adaptive system includes both humoral immunity components (B lymphocyte cells) and cell-mediated immunity (T lymphocyte cells) components. B cells are activated to secrete antibodies, which travel through the bloodstream and bind to the foreign antigen. Helper T cells (regulatory T cells, CD4+ cells) and cytotoxic T cells (CTL, CD8+ cells) are activated when their T cell receptor interacts with an antigen-hound MHC class I molecule. Cytokines help the T cells mature, which mature cells, in turn, produce cytokines which allows the production of additional T cells. Once activated, the helper T cells release cytokines which regulate and direct the activity of different immune cell types, including APCs, macrophages, neutrophils, and other lymphocytes, to kill and remove targeted cells. T helper cells have no cytotoxic or phagocytic activity themselves, instead acting as immune response mediators which direct other cells to perform these tasks. Helper T cells also secrete extra signals that assist in the activation of cytotoxic T cells. Upon activation, CTL undergoes clonal selection, in which it gains functions and divides rapidly to produce an army of activated effector cells. Activated CTL then travels throughout the body searching for cells that bear that unique MHC Class I and antigen. The effector CTLs release cytotoxins that form pores in the target cell's plasma membrane, causing apoptosis. Adaptive immunity also includes a "memory" that makes future responses against a specific antigen more efficient. Upon resolution of the infection, T helper cells and cytotoxic T cells die and are cleared away by phagocytes, however, a few of these cells remain as memory cells. If the same antigen is encountered at a later time, these memory cells quickly differentiate into effector cells, shortening the time required to mount an effective response.

An "immune checkpoint inhibitor" or "immune checkpoint" refers to a molecule that completely or partially reduces, inhibits, interferes with, or modulates one or more immune checkpoint proteins. Immune checkpoint proteins regulate T-cell activation or function, and are known in the art. Non-limiting examples include CTLA-4 and its ligands CD 80 and CD86, and PD-1 and its ligands PD-L1 and PD-L2. Immune checkpoint proteins are responsible for co-stimulatory or inhibitory interactions of T-cell responses, and regulate and maintain self-tolerance and physiological immune responses. Systemic immunotherapy, e.g., using CTLA-4 inhibitors, may alter immunoregulation, provoke immune dysfunction, and result in opportunistic autoimmune disorders (see, e.g., Kong et al., 2014).

A "co-stimulatory" molecule is an immune modulator that increase or activates a signal that stimulates an immune response or inflammatory response. A co-stimulatory molecule could be considered an immune checkpoint (immune checkpoints are molecules in the immune system that either turn up a signal (co-stimulatory molecules) or turn down a signal), but as used herein, a co-stimulatory molecule is not referred to as an immune checkpoint and instead is referred to as a co-stimulator. Thus, as used herein, "immune checkpoint" is meant to refer to an inhibitory immune checkpoint and not a co-stimulatory molecule.

As used herein, a genetically engineered microorganism, e.g., engineered bacterium, or anti-cancer molecule that "inhibits" cancerous cells refers to a bacterium or virus or molecule that is capable of reducing cell proliferation, reducing tumor growth, and/or reducing tumor volume by at least about 10%, 20%, 25%, 30%, 40%, 50%, 60%, 70%, 75%, 80%, 85%, 90%, 95%, or more as compared to control, e.g., an untreated control or an unmodified microorganism of the same subtype under the same conditions.

As used herein, a genetically engineered microorganism, e.g., engineered bacterium, or anti-cancer molecule that "inhibits" a biological molecule, such as an immune modulator, e.g., cytokine, chemokine, immune modulatory metabolite, or any other immune modulatory agent, factor, or molecule, refers to a bacterium or virus or anti-cancer molecule that is capable of reducing, decreasing, or eliminating the biological activity, biological function, and/or number of that biological molecule, e.g., immune modulator, as compared to control, e.g., an untreated control or an unmodified microorganism of the same subtype under the same conditions.

As used herein, a genetically engineered microorganism, e.g., engineered bacterium, or anti-cancer molecule that "activates" or "stimulates" a biological molecule, such as an immune modulator, e.g., cytokine, chemokine, immune modulatory metabolite, or any other immune modulatory agent, factor, or molecule, refers to a bacterium or virus or anti-cancer molecule that is capable of activating, increasing, enhancing, or promoting the biological activity, biological function, and/or number of that biological molecule, e.g., immune modulator, as compared to control, e.g., an untreated control or an unmodified microorganism of the same subtype under the same conditions.

"Tumor-targeting bacteria" refer to bacteria that are capable of directing themselves to cancerous cells. Tumor-targeting bacteria may be naturally capable of directing themselves to cancerous cells, necrotic tissues, and/or hypoxic tissues. In some embodiments, bacteria that are not naturally capable of directing themselves to cancerous cells, necrotic tissues, and/or hypoxic tissues are genetically engineered to direct themselves to cancerous cells, necrotic tissues, and/or hypoxic tissues. Tumor-targeting bacteria may be further engineered to enhance or improve desired biological properties, mitigate systemic toxicity, and/or ensure clinical safety. These species, strains, and/or subtypes may be attenuated, e.g., deleted for a toxin gene. In some embodiments, tumor-targeting bacteria have low infection capabilities. In some embodiments, tumor-targeting bacteria are motile. In some embodiments, the tumor-targeting bacteria are capable of penetrating deeply into the tumor, where standard treatments do not reach. In some embodiments, tumor-targeting bacteria are capable of colonizing at least 20%, at least 30%, at least 40%, at least 50%, at least 60%, at least 70%, at least 80%, at least 90%, or at least 95% of a malignant tumor. Examples of tumor-targeting bacteria include, but are not limited to, *Bifidobacterium, Caulobacter, Clostridium, Escherichia coli, Listeria, Mycobacterium, Salmonella, Streptococcus*, and *Vibrio*, e.g., *Bifidobacterium adolescentis, Bifidobacterium bifidum, Bifidobacterium breve* UCC2003, *Bifidobacterium infantis, Bifidobacterium longum, Clostridium acetobutylicum, Clostridium butyricum, Clostridium butyricum* M-55, *Clostridium butyricum miyairi, Clostridium cochlearum, Clostridium felsineum, Clostridium histolyticum, Clostridium multifermentans, Clostridium novyi*-NT, *Clostridium paraputrificum, Clostridium pasteureanum, Clostridium pectinovorum, Clostridium perfringens, Clostridium roseum, Clostridium sporogenes, Clostridium tertium, Clostridium tetani, Clostridium tyrobutyricum, Corynebacterium parvum, Escherichia coli* MG1655, *Escherichia coli* Nissle 1917, *Listeria monocytogenes, Mycobacterium bovis, Salmonella choleraesuis, Salmonella typhimurium*, and *Vibrio cholera* (Cronin et al., 2012; Forbes, 2006; Jain and Forbes, 2001; Liu et al., 2014; Morrissey et al., 2010; Nuno et al., 2013; Patyar et al., 2010; Cronin, et al., Mol Ther 2010; 18:1397-407). In some embodiments, the tumor-targeting bacteria are non-pathogenic bacteria.

"Tumor-targeting oncolytic virus" refer to virus that are capable of directing themselves to cancerous cells. Tumor-targeting virus may be naturally capable of directing themselves to cancerous cells, necrotic tissues, and/or hypoxic tissues. Oncolytic viruses that are not naturally capable of directing themselves to cancerous cells, necrotic tissues, and/or hypoxic tissues can be genetically engineered to direct themselves to cancerous cells, necrotic tissues, and/or hypoxic tissues. In addition, they can be further engineered to target specific cancer or cell types. Tumor-targeting oncolytic viruses may also be engineered to enhance or improve desired biological properties (e.g., lytic properties), mitigate systemic toxicity, and/or ensure clinical safety. These species, strains, and/or subtypes may be attenuated, e.g., deleted for a toxin gene. In some embodiments, tumor-targeting bacteria have low infection capabilities. Examples of tumor-targeting oncolytic viruses are reviewed in Chlocca et al., Cancer Immunol research, 2014, 2:295-300 and Kaufman, et al., Nature, 2016, 14:642-662.

"Microorganism" refers to an organism or microbe of microscopic, submicroscopic, or ultramicroscopic size that typically consists of a single cell. Examples of microorganisms include bacteria, viruses, parasites, fungi, certain algae, protozoa, and yeast. In some aspects, the microorganism is engineered ("engineered microorganism") to produce one or more anti-cancer molecules. In certain embodiments, the engineered microorganism is an engineered bacterium. In certain embodiments, the engineered microorganism is an engineered yeast.

As used herein, the term "recombinant microorganism" refers to a microorganism, e.g., bacterial, yeast, or viral cell, or bacteria, yeast, or virus, that has been genetically modified from its native state. Thus, a "recombinant bacterial cell" or "recombinant bacteria" refers to a bacterial cell or bacteria that have been genetically modified from their native state. For instance, a recombinant bacterial cell may have nucleotide insertions, nucleotide deletions, nucleotide rearrangements, and nucleotide modifications introduced into their DNA. These genetic modifications may be present in the chromosome of the bacteria or bacterial cell, or on a plasmid in the bacteria or bacterial cell. Recombinant bacterial cells disclosed herein may comprise exogenous nucleotide sequences on plasmids. Alternatively, recombinant bacterial cells may comprise exogenous nucleotide sequences stably incorporated into their chromosome.

A "programmed or engineered microorganism" refers to a microorganism, e.g., bacterial, yeast, or viral cell, or bacteria, yeast, or virus, that has been genetically modified from its native state to perform a specific function. Thus, a "programmed or engineered bacterial cell" or "programmed or engineered bacteria" refers to a bacterial cell or bacteria that has been genetically modified from its native state to perform a specific function. In certain embodiments, the programmed or engineered bacterial cell has been modified to express one or more proteins, for example, one or more proteins that have a therapeutic activity or serve a therapeutic purpose. The programmed or engineered bacterial cell may additionally have the ability to stop growing or to destroy itself once the protein(s) of interest have been expressed.

"Non-pathogenic bacteria" refer to bacteria that are not capable of causing disease or harmful responses in a host. In some embodiments, non-pathogenic bacteria are Gram-negative bacteria. In some embodiments, non-pathogenic bacteria are Gram-positive bacteria. In some embodiments, non-pathogenic bacteria do not contain lipopolysaccharides (LPS). In some embodiments, non-pathogenic bacteria are commensal bacteria. Examples of non-pathogenic bacteria include, but are not limited to certain strains belonging to the genus *Bacillus, Bacteroides, Bifidobacterium, Brevibacteria, Clostridium, Enterococcus, Escherichia coli, Lactobacillus, Lactococcus, Saccharomyces*, and *Staphylococcus*, e.g., *Bacillus coagulans, Bacillus subtilis, Bacteroides fragilis, Bacteroides subtilis, Bacteroides thetaiotaomicron, Bifidobacterium bifidum, Bifidobacterium infantis, Bifidobacterium lactis, Bifidobacterium longum, Clostridium butyricum, Enterococcus faecium, Escherichia coli* Nissle, *Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis*, and *Saccharomyces boulardii* (Sonnenborn et al., 2009; Dinleyici et al., 2014; U.S. Pat. Nos. 6,835,376; 6,203,797; 5,589,168; 7,731,976). Naturally pathogenic bacteria may be genetically engineered to provide reduce or eliminate pathogenicity.

"Probiotic" is used to refer to live, non-pathogenic microorganisms, e.g., bacteria, which can confer health benefits to a host organism that contains an appropriate amount of the microorganism. In some embodiments, the host organism is a mammal. In some embodiments, the host organism is a human. In some embodiments, the probiotic bacteria are Gram-negative bacteria. In some embodiments, the probiotic bacteria are Gram-positive bacteria. Some species, strains, and/or subtypes of non-pathogenic bacteria are currently recognized as probiotic bacteria. Examples of probiotic bacteria include, but are not limited to certain strains belonging to the genus Bifidobacteria, *Escherichia coli, Lactobacillus*, and *Saccharomyces*, e.g., *Bifidobacterium bifidum, Enterococcus faecium, Escherichia coli* strain Nissle, *Lactobacillus acidophilus, Lactobacillus bulgaricus, Lactobacillus paracasei, Lactobacillus plantarum*, and *Sac-*

*charomyces boulardii* (Dinleyici et al., 2014; U.S. Pat. Nos. 5,589,168; 6,203,797; 6,835,376). The probiotic may be a variant or a mutant strain of bacterium (Arthur et al., 2012; Cuevas-Ramos et al., 2010; Olier et al., 2012; Nougayrede et al., 2006). Non-pathogenic bacteria may be genetically engineered to enhance or improve desired biological properties, e.g., survivability. Non-pathogenic bacteria may be genetically engineered to provide probiotic properties. Probiotic bacteria may be genetically engineered or programmed to enhance or improve probiotic properties.

As used herein, an "oncolytic virus" (OV) is a virus having the ability to specifically infect and lyse cancer cells, while leaving normal cells unharmed. Oncolytic viruses of interest include, but are not limited to adenovirus, Coxsackie, Reovirus, herpes simplex virus (HSV), vaccinia, fowl pox, vesicular stomatitis virus (VSV), measles, and Parvovirus, and also includes rabies, west nile virus, Newcastle disease and genetically modified versions thereof. A non-limiting example of an OV is Talimogene Laherparepvec (T-VEC), the first oncolytic virus to be licensed by the FDA as a cancer therapeutic.

"Operably linked" refers a nucleic acid sequence, e.g., a gene encoding a CTLA-4 inhibitor, that is joined to a regulatory region sequence in a manner which allows expression of the nucleic acid sequence, e.g., acts in cis. A regulatory region is a nucleic acid that can direct transcription of a gene of interest and may comprise promoter sequences, enhancer sequences, response elements, protein recognition sites, inducible elements, promoter control elements, protein binding sequences, 5' and 3' untranslated regions, transcriptional start sites, termination sequences, polyadenylation sequences, and introns.

An "inducible promoter" refers to a regulatory region that is operably linked to one or more genes, wherein expression of the gene(s) is increased in the presence of an inducer of said regulatory region.

"Exogenous environmental condition(s)" refer to setting(s) or circumstance(s) under which the promoter described herein is induced. In some embodiments, the exogenous environmental conditions are specific to a malignant growth containing cancerous cells, e.g., a tumor. The phrase "exogenous environmental conditions" is meant to refer to the environmental conditions external to the intact (unlysed) engineered microorganism, but endogenous or native to tumor environment or the host subject environment. Thus, "exogenous" and "endogenous" may be used interchangeably to refer to environmental conditions in which the environmental conditions are endogenous to a mammalian body, but external or exogenous to an intact microorganism cell. In some embodiments, the exogenous environmental conditions are low-oxygen, microaerobic, or anaerobic conditions, such as hypoxic and/or necrotic tissues. Some solid tumors are associated with low intracellular and/or extracellular pH; in some embodiments, the exogenous environmental condition is a low-pH environment. In some embodiments, the genetically engineered microorganism of the disclosure comprise a pH-dependent promoter. In some embodiments, the genetically engineered microorganism of the disclosure comprise an oxygen level-dependent promoter. In some aspects, bacteria have evolved transcription factors that are capable of sensing oxygen levels. Different signaling pathways may be triggered by different oxygen levels and occur with different kinetics. An "oxygen level-dependent promoter" or "oxygen level-dependent regulatory region" refers to a nucleic acid sequence to which one or more oxygen level-sensing transcription factors is capable of binding, wherein the binding and/or activation of the corresponding transcription factor activates downstream gene expression.

Examples of oxygen level-dependent transcription factors include, but are not limited to, FNR (fumarate and nitrate reductase), ANR, and DNR. Corresponding FNR-responsive promoters, ANR (anaerobic nitrate respiration)-responsive promoters, and DNR (dissimilatory nitrate respiration regulator)-responsive promoters are known in the art (see, e.g., Castiglione et al., 2009; Eiglmeier et al., 1989; Galimand et al., 1991; Hasegawa et al., 1998; Hoeren et al., 1993; Salmon et al., 2003), and non-limiting examples are shown in Table 2.

In a non-limiting example, a promoter (PfnrS) was derived from the *E. coli* Nissle fumarate and nitrate reductase gene S (fnrS) that is known to be highly expressed under conditions of low or no environmental oxygen (Durand and Storz, 2010; Boysen et al, 2010). The PfnrS promoter is activated under anaerobic conditions by the global transcriptional regulator FNR that is naturally found in Nissle. Under anaerobic conditions, FNR forms a dimer and binds to specific sequences in the promoters of specific genes under its control, thereby activating their expression. However, under aerobic conditions, oxygen reacts with iron-sulfur clusters in FNR dimers and converts them to an inactive form. In this way, the PfnrS inducible promoter is adopted to modulate the expression of proteins or RNA. PfnrS is used interchangeably in this application as FNRS, fnrs, FNR, P-FNRS promoter and other such related designations to indicate the promoter PfnrS.

TABLE 2

Examples of transcription factors and responsive genes and regulatory regions

| Transcription Factor | Examples of responsive genes, promoters, and/or regulatory regions: |
|---|---|
| FNR | nirB, ydfZ, pdhR, focA, ndH, hlyE, narK, narX, narG, yfiD, tdcD |
| ANR | arcDABC |
| DNR | norb, norC |

As used herein, a "non-native" nucleic acid sequence refers to a nucleic acid sequence not normally present in a microorganism, e.g., an extra copy of an endogenous sequence, or a heterologous sequence such as a sequence from a different species, strain, or substrain of bacteria or virus, or a sequence that is modified and/or mutated as compared to the unmodified sequence from bacteria or virus of the same subtype. In some embodiments, the non-native nucleic acid sequence is a synthetic, non-naturally occurring sequence (see, e.g., Purcell et al., 2013). The non-native nucleic acid sequence may be a regulatory region, a promoter, a gene, and/or one or more genes in gene cassette. In some embodiments, "non-native" refers to two or more nucleic acid sequences that are not found in the same relationship to each other in nature. The non-native nucleic acid sequence may be present on a plasmid or chromosome. In some embodiments, the genetically engineered bacteria of the disclosure comprise a gene that is operably linked to a directly or indirectly inducible promoter that is not associated with said gene in nature, e.g., an FNR-responsive promoter (or other promoter described herein) operably linked to a gene encoding an anti-cancer molecule.

"Constitutive promoter" refers to a promoter that is capable of facilitating continuous transcription of a coding sequence or gene under its control and/or to which it is operably linked. Constitutive promoters and variants are well known in the art and include, but are not limited to, BBa_J23100, a constitutive *Escherichia coli* $\sigma^S$ promoter (e.g., an osmY promoter (International Genetically Engineered Machine (iGEM) Registry of Standard Biological Parts Name BBa_J45992; BBa_J45993)), a constitutive *Escherichia coli* $\sigma^{32}$ promoter (e.g., htpG heat shock promoter (BBa_J45504)), a constitutive *Escherichia coli* $\sigma^{70}$ promoter (e.g., lacq promoter (BBa_J54200; BBa_J56015), *E. coli* CreABCD phosphate sensing operon promoter (BBa_J64951), GlnRS promoter (BBa_K088007), lacZ promoter (BBa_K119000; BBa_K119001); M13K07 gene I promoter (BBa_M13101); M13K07 gene II promoter (BBa_M13102), M13K07 gene III promoter (BBa_M13103), M13K07 gene IV promoter (BBa_M13104), M13K07 gene V promoter (BBa_M13105), M13K07 gene VI promoter (BBa_M13106), M13K07 gene VIII promoter (BBa_M13108), M13110 (BBa_M13110)), a constitutive *Bacillus subtilis* $\sigma^A$ promoter (e.g., promoter veg (BBa_K143013), promoter 43 (BBa_K143013), $P_{liag}$ (BBa_K823000), $P_{lepA}$ (BBa_K823002), $P_{veg}$ (BBa_K823003)), a constitutive *Bacillus subtilis* $G^B$ promoter (e.g., promoter ctc (BBa_K143010), promoter gsiB (BBa_K143011)), a *Salmonella* promoter (e.g., Pspv2 from *Salmonella* (BBa_K112706), Pspv from *Salmonella* (BBa_K112707)), a bacteriophage T7 promoter (e.g., T7 promoter (BBa_I712074; BBa_I719005; BBa_J34814; BBa_J64997; BBa_K113010; BBa_K113011; BBa_K113012; BBa_R0085; BBa_R0180; BBa_R0181; BBa_R0182; BBa_R0183; BBa_Z0251; BBa_Z0252; BBa_Z0253)), and a bacteriophage SP6 promoter (e.g., SP6 promoter (BBa_J64998)). In some embodiments, such promoters are active in vitro, e.g., under culture, expansion and/or manufacture conditions. In some embodiments, such promoters are active in vivo, e.g., in conditions found in the in vivo environment, e.g., the gut and/or the tumor microenvironment.

As used herein, "stably maintained" or "stable" bacterium or virus is used to refer to a bacterial or viral host cell carrying non-native genetic material, e.g., an anti-cancer molecule, such that the non-native genetic material is retained, expressed, and propagated. The stable bacterium or virus is capable of survival and/or growth in vitro, e.g., in medium, and/or in vivo, e.g., in hypoxic and/or necrotic tissues. For example, the stable bacterium or virus may be a genetically engineered bacterium or genetically engineered virus comprising non-native genetic material encoding an anti-cancer molecule, in which the plasmid or chromosome carrying the non-native genetic material is stably maintained in the bacterium or virus, such that the anti-cancer molecule can be expressed in the bacterium or virus, and the bacterium or virus is capable of survival and/or growth in vitro and/or in vivo.

As used herein, the terms "modulate" and "treat" and their cognates refer to an amelioration of a cancer, or at least one discernible symptom thereof. In another embodiment, "modulate" and "treat" refer to an amelioration of at least one measurable physical parameter, not necessarily discernible by the patient. In another embodiment, "modulate" and "treat" refer to inhibiting the progression of a cancer, either physically (e.g., stabilization of a discernible symptom), physiologically (e.g., stabilization of a physical parameter), or both. In another embodiment, "modulate" and "treat" refer to slowing the progression or reversing the progression of a cancer. As used herein, "prevent" and its cognates refer to delaying the onset or reducing the risk of acquiring a given cancer.

Those in need of treatment may include individuals already having a particular cancer, as well as those at risk of having, or who may ultimately acquire the cancer. The need for treatment is assessed, for example, by the presence of one or more risk factors associated with the development of a cancer (e.g., alcohol use, tobacco use, obesity, excessive exposure to ultraviolet radiation, high levels of estrogen, family history, genetic susceptibility), the presence or progression of a cancer, or likely receptiveness to treatment of a subject having the cancer. Cancer is caused by genomic instability and high mutation rates within affected cells. Treating cancer may encompass eliminating symptoms associated with the cancer and/or modulating the growth and/or volume of a subject's tumor, and does not necessarily encompass the elimination of the underlying cause of the cancer, e.g., an underlying genetic predisposition.

As used herein, the term "conventional cancer treatment" or "conventional cancer therapy" refers to treatment or therapy that is widely accepted and used by most healthcare professionals. It is different from alternative or complementary therapies, which are not as widely used. Examples of conventional treatment for cancer include surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, therapy, and blood product donation and transfusion.

As used herein a "pharmaceutical composition" refers to a preparation of genetically engineered microorganism of the disclosure with other components such as a physiologically suitable carrier and/or excipient.

The phrases "physiologically acceptable carrier" and "pharmaceutically acceptable carrier" which may be used interchangeably refer to a carrier or a diluent that does not cause significant irritation to an organism and does not abrogate the biological activity and properties of the administered bacterial or viral compound. An adjuvant is included under these phrases.

The term "excipient" refers to an inert substance added to a pharmaceutical composition to further facilitate administration of an active ingredient. Examples include, but are not limited to, calcium bicarbonate, calcium phosphate, various sugars and types of starch, cellulose derivatives, gelatin, vegetable oils, polyethylene glycols, and surfactants, including, for example, polysorbate 20.

The terms "therapeutically effective dose" and "therapeutically effective amount" are used to refer to an amount of a compound that results in prevention, delay of onset of symptoms, or amelioration of symptoms of a condition, e.g., a cancer. A therapeutically effective amount may, for example, be sufficient to treat, prevent, reduce the severity, delay the onset, and/or reduce the risk of occurrence of one or more symptoms of a disorder associated with cancerous cells. A therapeutically effective amount, as well as a therapeutically effective frequency of administration, can be determined by methods known in the art and discussed below.

The articles "a" and "an," as used herein, should be understood to mean "at least one," unless clearly indicated to the contrary.

The phrase "and/or," when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

Bacteria

The genetically engineered microorganism, or programmed microorganisms, such as genetically engineered bacterium of the disclosure is capable of local and tumor-specific delivery of anti-cancer molecules, thereby reducing the systemic cytotoxicity and/or immune dysfunction associated with systemic administration of said molecules. The engineered bacteria may be administered systemically, orally, locally and/or intratumorally. In some embodiments, the genetically engineered bacteria are capable of targeting cancerous cells, particularly in the hypoxic regions of a tumor, and producing an anti-cancer molecule, e.g., an immune checkpoint inhibitor or other anti-cancer molecule provided herein. In some embodiments, the genetically engineered bacterium is a tumor-targeting bacterium that expresses an anti-cancer molecule under the control of a promoter that is activated by low-oxygen conditions, e.g., the hypoxic environment of a tumor.

In some embodiments, the tumor-targeting microorganism is a bacterium that is naturally capable of directing itself to cancerous cells, necrotic tissues, and/or hypoxic tissues. For example, bacterial colonization of tumors may be achieved without any specific genetic modifications in the bacteria or in the host (Yu et al., 2008). In some embodiments, the tumor-targeting bacterium is a bacterium that is not naturally capable of directing itself to cancerous cells, necrotic tissues, and/or hypoxic tissues, but is genetically engineered to do so. In some embodiments, the genetically engineered bacteria spread hematogenously to reach the targeted tumor(s). Bacterial infection has been linked to tumor regression (Hall, 1998; Nauts and McLaren, 1990), and certain bacterial species have been shown to localize to and lyse necrotic mammalian tumors (Jain and Forbes, 2001). Non-limiting examples of tumor-targeting bacteria are shown in Table 3.

TABLE 3

Bacteria with tumor-targeting capability

| Bacterial Strain | See, e.g., |
|---|---|
| *Clostridium novyi*-NT | Forbes, Neil S. "Profile of a bacterial tumor killer." *Nature biotechnology* 24.12 (2006): 1484-1485. |
| *Bifidobacterium* spp<br>*Streptococcus* spp<br>*Caulobacter* spp<br>*Clostridium* spp<br>*Escherichia coli* MG1655<br>*Escherichia coli* Nissle<br>*Bifidobacterium breve* UCC2003<br>*Salmonella typhimurium* | Liu, Sai, et al. "Tumor-targeting bacterial therapy: A potential treatment for oral cancer." *Oncology letters* 8.6 (2014): 2359-2366.<br>Cronin, Michelle, et al. "High resolution in vivo bioluminescent imaging for the study of bacterial tumour targeting." *PloS one* 7.1 (2012): e30940.; Zhou, et al., Med Hypotheses. April 2011; 76(4): 533-4. doi: 10.1016/j.mehy.2010.12.010. Epub 2011 Jan. 21; Zhang et al., Appl Environ Microbiol. November 2012; 78(21): 7603-7610; Danino et al., Science Translational Medicine, 2015 Vol 7 Issue 289, pp. 289ra84 |
| *Clostridium novyi*-NT<br>*Bifidobacterium* spp<br>*Mycobacterium bovis*<br>*Listeria monocytogenes*<br>*Escherichia coli*<br>*Salmonella* spp<br>*Salmonella typhimurium* | Bernardes, Nuno, Ananda M. Chakrabarty, and Arsenio M. Fialho. "Engineering of bacterial strains and their products for cancer therapy." *Applied microbiology and biotechnology* 97.12 (2013): 5189-5199. |
| *Salmonella choleraesuis*<br>*Vibrio cholera*<br>*Listeria monocytogenes*<br>*Escherichia coli*<br>*Bifidobacterium adolescentis*<br>*Clostridium acetobutylicum*<br>*Salmonella typhimurium*<br>*Clostridium histolyticum* | Patyar, S., et al. "Bacteria in cancer therapy: a novel experimental strategy." *J Biomed Sci* 17.1 (2010): 21-30. |
| *Escherichia coli* Nissle 1917 | Danino et al. "Programmable probiotics for detection of cancer in urine." Sci Transl Med. 2015 May 27; 7(289): 289ra84 |

The tumor-targeting capability of certain bacteria appears to be dependent on the stage of tumor development, but independent of tumor type (Yu et al., 2008). Intravenously injected bacteria have been shown to target the central portion of tumors and coincide with the necrotic regions of those tumors (Yu et al., 2008) Inflammation alone has been shown to be insufficient to sustain bacterial colonization (Yu et al., 2008). In some embodiments, tumors are sensitized, e.g., by oncolytic vaccinia virus, prior to bacterial delivery to enhance colonization. In some embodiments, the blood-borne bacteria enter tumors and are able to amplify in the central necrotic region because clearance of bacteria is inhibited (Yu et al., 2008).

In some embodiments, the gene of interest is expressed in a bacterium which enhances the efficacy of immunotherapy. Vétizou et al (2015) describe T cell responses specific for *Bacteroides* thetaiotaomicron or *Bacteroides fragilis* that were associated with the efficacy of CTLA-4 blockade in mice and in patients. Sivan et al. (2015) illustrate the importance of *Bifidobacterium* to antitumor immunity and anti-PD-L1 antibody against (PD-1 ligand) efficacy in a mouse model of melanoma. In some embodiments, the bacteria expressing the one or more anti-cancer molecules are *Bacteroides*. In some embodiments, the bacteria expressing the one or more anticancer molecules are *Bifidobacterium*. In some embodiments, the bacteria expressing the one or more anticancer molecules are *Escherichia Coli* Nissle. In some embodiments, the bacteria expressing the one or more anticancer molecules are *Clostridium novyi*-NT. In some embodiments, the bacteria expressing the one or more anticancer molecules are *Clostridium butyricum* miyairi.

In certain embodiments, the genetically engineered bacteria are obligate anaerobic bacteria. In certain embodiments, the genetically engineered bacteria are facultative anaerobic bacteria. In certain embodiments, the genetically engineered bacteria are aerobic bacteria. In some embodiments, the genetically engineered bacteria are Gram-positive bacteria and lack LPS. In some embodiments, the genetically engineered bacteria are Gram-negative bacteria. In some embodiments, the genetically engineered bacteria are Gram-positive and obligate anaerobic bacteria. In some embodiments, the genetically engineered bacteria are Gram-positive and facultative anaerobic bacteria. In some embodiments, the genetically engineered bacteria are non-pathogenic bacteria. In some embodiments, the genetically engineered bacteria are commensal bacteria. In some embodiments, the genetically engineered bacteria are probiotic bacteria. In some embodiments, the genetically engineered bacteria are naturally pathogenic bacteria that are modified or mutated to reduce or eliminate pathogenicity. Exemplary bacteria include, but are not limited to, *Bacillus, Bacteroides, Bifidobacterium, Brevibacteria, Caulobacter, Clostridium, Enterococcus, Escherichia coli, Lactobacillus, Lactococcus, Listeria, Mycobacterium, Saccharomyces, Salmonella, Staphylococcus, Streptococcus, Vibrio, Bacillus coagulans, Bacillus subtilis, Bacteroides fragilis, Bacteroides subtilis, Bacteroides thetaiotaomicron, Bifidobacterium adolescentis, Bifidobacterium bifidum, Bifidobacterium breve* UCC2003, *Bifidobacterium infantis, Bifidobacterium lactis, Bifidobacterium longum, Clostridium acetobutylicum, Clostridium butyricum, Clostridium butyricum* M-55, *Clostridium butyricum* miyairi, *Clostridium cochlearum, Clostridium felsineum, Clostridium histolyticum, Clostridium multifermentans, Clostridium novyi*-NT, *Clostridium paraputrificum, Clostridium pasteureanum, Clostridium pectinovorum, Clostridium perfringens, Clostridium roseum, Clostridium sporogenes, Clostridium tertium, Clostridium tetani, Clostridium tyrobutyricum, Corynebacterium parvum, Escherichia coli* MG1655, *Escherichia coli* Nissle 1917, *Listeria monocytogenes, Mycobacterium bovis, Salmonella choleraesuis, Salmonella typhimurium, Vibrio cholera*, and the bacteria shown in Table 3. In certain embodiments, the genetically engineered bacteria are selected from the group consisting of *Enterococcus faecium, Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis*, and *Saccharomyces boulardii*. In certain embodiments, the genetically engineered bacteria are selected from the group consisting of *Bacteroides fragilis, Bacteroides thetaiotaomicron, Bacteroides subtilis, Bifidobacterium bifidum, Bifidobacterium infantis, Bifidobacterium lactis, Clostridium butyricum, Escherichia coli* Nissle, *Lactobacillus acidophilus, Lactobacillus plantarum, Lactobacillus reuteri*, and *Lactococcus lactis*. In some embodiments, *Lactobacillus* is used for tumor-specific delivery of one or more anti-cancer molecules. *Lactobacillus casei* injected intravenously has been found to accumulate in tumors, which was enhanced through nitroglycerin (NG), a commonly used NO donor, likely due to the role of NO in increasing the blood flow to hypovascular tumors (Fang et al, 2016 (Methods Mol Biol. 2016; 1409:9-23. Enhancement of Tumor-Targeted Delivery of Bacteria with Nitroglycerin Involving Augmentation of the EPR Effect).

In some embodiments, the genetically engineered bacteria are obligate anaerobes. In some embodiments, the genetically engineered bacteria are Clostridia and capable of tumor-specific delivery of anti-cancer molecules. Clostridia are obligate anaerobic bacterium that produce spores and are naturally capable of colonizing and in some cases lysing hypoxic tumors (Groot et al., 2007). In experimental models, Clostridia have been used to deliver prodrug converting enzymes and enhance radiotherapy (Groot et al., 2007). In some embodiments, the genetically engineered bacteria is selected from the group consisting of *Clostridium novyi*-NT, *Clostridium histolyticium, Clostridium tetani, Clostridium oncolyticum, Clostridium sporogenes*, and *Clostridium beijerinckii* (Liu et al., 2014). In some embodiments, the *Clostridium* is naturally non-pathogenic. For example, *Clostridium oncolyticum* is a pathogenic and capable of lysing tumor cells. In alternate embodiments, the *Clostridium* is naturally pathogenic but modified to reduce or eliminate pathogenicity. For example, *Clostridium novyi* are naturally pathogenic, and *Clostridium novyi*-NT are modified to remove lethal toxins. *Clostridium novyi*-NT and *Clostridium sporogenes* have been used to deliver single-chain HIF-1α antibodies to treat cancer and is an "excellent tumor colonizing *Clostridium* strains" (Groot et al., 2007).

In some embodiments, the genetically engineered bacteria facultative anaerobes. In some embodiments, the genetically engineered bacteria are *Salmonella*, e.g., *Salmonella typhimurium*, and are capable of tumor-specific delivery of anti-cancer molecules. *Salmonella* are non-spore-forming Gram-negative bacteria that are facultative anaerobes. In some embodiments, the *Salmonella* are naturally pathogenic but modified to reduce or eliminate pathogenicity. For example, *Salmonella typhimurium* is modified to remove pathogenic sites (attenuated). In some embodiments, the genetically engineered bacteria are *Bifidobacterium* and capable of tumor-specific delivery of anti-cancer molecules. *Bifidobacterium* are Gram-positive, branched anaerobic bacteria. In some embodiments, the *Bifidobacterium* is naturally non-pathogenic. In alternate embodiments, the *Bifidobacterium* is naturally pathogenic but modified to reduce or eliminate pathogenicity. *Bifidobacterium* and *Salmonella* have been shown to preferentially target and replicate in the hypoxic and necrotic regions of tumors (Yu et al., 2014).

In some embodiments, the genetically engineered bacteria are Gram-negative bacteria. In some embodiments, the genetically engineered bacteria are *E. coli*. For example, *E. coli* Nissle has been shown to preferentially colonize tumor tissue in vivo following either oral or intravenous administration (Zhang et al., 2012 and Danino et al., 2015). *E. coli* have also been shown to exhibit robust tumor-specific replication (Yu et al., 2008). In some embodiments, the genetically engineered bacteria are *Escherichia coli* strain Nissle 1917 (*E. coli* Nissle), a Gram-negative bacterium of the Enterobacteriaceae family that "has evolved into one of the best characterized probiotics" (Ukena et al., 2007). The strain is characterized by its complete harmlessness (Schultz, 2008), and has GRAS (generally recognized as safe) status (Reister et al., 2014, emphasis added).

The genetically engineered bacteria of the invention may be destroyed, e.g., by defense factors in tissues or blood serum (Sonnenborn et al., 2009). In some embodiments, the genetically engineered bacteria are administered repeatedly. In some embodiments, the genetically engineered bacteria are administered once.

In certain embodiments, the anti-cancer molecule (s) described herein are expressed in one species, strain, or subtype of genetically engineered bacteria. In alternate embodiments, the anti-cancer molecule is expressed in two or more species, strains, and/or subtypes of genetically engineered bacteria. One of ordinary skill in the art would appreciate that the genetic modifications disclosed herein may be modified and adapted for other species, strains, and subtypes of bacteria.

Further examples of bacteria which are suitable are described in International Patent Publication WO/2014/043593, the contents of which is herein incorporated by reference in its entirety. In some embodiments, such bacteria are mutated to attenuate one or more virulence factors.

In some aspects, the engineered bacteria can be combined with other cancer therapies, e.g., conventional anti-cancer therapies, other immunotherapies, and/or engineered or unengineered oncolytic viruses.

Anti-Cancer Molecules

Elimination (Reversal) of Local Immune Suppression

Tumor cells often escape destruction by producing signals that interfere with antigen presentation or maturation of dendritic cells, causing their precursors to mature into immunosuppressive cell types instead. Therefore, the local delivery of one or more anti-cancer molecules that prevent or inhibit the activities of immunomodulatory molecules involved in initiating, promoting and/or maintaining immunosuppression at the tumor site, alone or in combination with one or more other anti-cancer molecules, provides a therapeutic benefit.

Immune Checkpoint Inhibitors

In some embodiments, the anti-cancer molecule is an inhibitor of an immune suppressor molecule, for example, an inhibitor of an immune checkpoint molecule. The immune checkpoint molecule to be inhibited can be any known or later discovered immune checkpoint molecule or other immune suppressor molecule. In some embodiments, the immune checkpoint molecule, or other immune suppressor molecule, to be inhibited is selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. In certain aspects, the present disclosure provides an engineered microorganism, e.g., engineered bacteria, that is engineered to produce one or more anti-cancer molecules that inhibit an immune checkpoint or other immune suppressor molecule. In some embodiments, the genetically engineered microorganisms are capable of reducing cancerous cell proliferation, tumor growth, and/or tumor volume. In some embodiments, the genetically engineered bacterium is a tumor-targeting bacterium of has been engineered to target a cancer or tumor cell. In some embodiments, the genetically engineered microorganism is a bacterium that expresses an immune checkpoint inhibitor, or inhibitor of another immune suppressor molecule, under the control of a promoter that is activated by low-oxygen conditions, e.g., the low-oxygen environment of a tumor. In some embodiments, the genetically engineered bacterium express one or more immune checkpoint inhibitors, under the control of a promoter that is activated by hypoxic conditions or by inflammatory conditions, such as any of the promoters activated by said conditions and described herein.

In some embodiments, the genetically engineered microorganisms of the disclosure are genetically engineered bacteria comprising a gene encoding a CTLA-4 inhibitor, for example, an antibody directed against CTLA-4. In any of these embodiments, the anti-CTLA-4 antibody may be a single-chain anti-CTLA-4 antibody. In some embodiments, the genetically engineered microorganisms of the disclosure are genetically engineered bacteria comprising a gene encoding a PD-1 inhibitor, for example, an antibody directed against PD-1. In any of these embodiments, the anti-PD-1 antibody may be a single-chain anti-PD-1 antibody. In some embodiments, the genetically engineered microorganisms of the disclosure are engineered bacteria comprising a gene encoding an inhibitor selected from PD-L1, PD-L2, TIGIT, VISTA, LAG-3, TIN/11, TIM3, CEACAM1, LAIR-1, HVEM, BTLA, CD160, CD200, CD200R, CD39, CD73, B7-H3, B7-H4, IDO, TDO, KIR, and A2aR inhibitors, e.g., an antibody directed against any of the listed immune checkpoints or other suppressor molecules. In any of these embodiments, the antibody may be a single-chain antibody. In some embodiments, the engineered bacteria expressing a checkpoint inhibitor, or inhibitor of another immune suppressor molecule, is administered locally, e.g., via intratumoral injection. In some embodiments, the engineered bacteria expressing a checkpoint inhibitor, or inhibitor of another immune suppressor molecule, is a tumor-targeting bacterium. In some embodiments, the genetically engineered microorganisms of the disclosure are tumor-targeting bacteria comprising a gene encoding a CTLA-4 inhibitor, e.g., an anti-CTLA-4 antibody, and are capable of delivering the anti-cancer molecule specifically and locally to cancerous cells. In some embodiments, the genetically engineered bacteria of the disclosure are tumor-targeting bacteria comprising a gene encoding a PD-1 inhibitor, e.g., an anti-PD-1 antibody, and are capable of delivering the anti-cancer molecule specifically and locally to cancerous cells. In other embodiments, the genetically engineered bacteria are tumor-targeting bacteria comprising a gene encoding an inhibitor of a checkpoint, or an inhibitor of another immune suppressor molecule, selected from PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR, e.g., an antibody against any of such molecules and are capable of delivering the anti-cancer molecule specifically and locally to cancerous cells.

In other embodiments, the genetically engineered bacteria of the disclosure comprise one or more genes encoding one or more inhibitors of an immune checkpoint or other immune suppressor molecule, selected from CTLA-4, PD-1, PD-L1, PD-L2, TIGIT, VISTA, LAG-3, TIM1, TIM3, CEACAM1, LAIR-1, HVEM, BTLA, CD160, CD200, CD200R, CD39, CD73, B7-H3, B7-H4, IDO, TDO, KIR, and A2aR. The genetically engineered bacteria can be delivered locally, e.g., via intratumoral injection or can be tumor targeting bacteria that are delivered systemically and home to the targeted tumor.

In some embodiments, the disclosure provides a genetically engineered microorganism, e.g., engineered bacterium, that expresses a CTLA-4 inhibitor. In some embodiments, the genetically engineered bacterium expresses a CTLA-4 inhibitor under the control of a promoter that is activated by low-oxygen conditions, e.g., the hypoxic environment of a tumor. In some embodiments, the genetically engineered bacterium expresses an anti-CTLA-4 antibody, for example, a single chain antibody. In some embodiments, the genetically engineered bacterium is a tumor-targeting bacterium that expresses an anti-CTLA-4 antibody, for example, a single chain antibody. In some embodiments, the genetically engineered bacterium expresses an anti-CTLA-4 antibody, for example, a single chain antibody, under the control of a promoter that is activated by low-oxygen conditions. In some embodiments, the genetically engineered bacterium is a tumor-targeting bacterium that expresses an anti-CTLA-4 antibody, for example, a single chain antibody, under the control of a promoter that is activated by low-oxygen conditions.

In some embodiments, the genetically engineered bacterium expresses a CD-80 inhibitor. In some embodiments, the genetically engineered bacterium expresses an anti-CD80 antibody, e.g., single chain antibody. In some embodiments, the genetically engineered bacterium is a tumor-targeting bacterium that expresses an anti-CD80 antibody, e.g., single chain antibody. In some embodiments, the genetically engineered bacterium expresses an anti-CD80 antibody, e.g., single chain antibody under the control of a promoter that is activated by low-oxygen conditions. In some embodiments, the genetically engineered bacterium is a tumor-targeting bacterium that expresses an anti-CD80 antibody, e.g., single chain antibody under the control of a promoter that is activated by low-oxygen conditions.

In some embodiments, the genetically engineered bacterium expresses a CD-86 inhibitor. In some embodiments, the genetically engineered bacterium expresses an anti-CD86 antibody, e.g., single chain antibody. In some embodiments, the genetically engineered bacterium is a tumor-targeting bacterium that expresses an anti-CD86 antibody, e.g., single chain antibody. In some embodiments, the genetically engineered bacterium expresses an anti-CD86 antibody, e.g., single chain antibody under the control of a promoter that is activated by low-oxygen conditions. In some embodiments, the genetically engineered bacterium is a tumor-targeting bacterium that expresses an anti-CD86 antibody, e.g., single chain antibody under the control of a promoter that is activated by low-oxygen conditions.

In any of these embodiments, the anti-immune checkpoint antibody can be a single chain antibody. In any of these embodiments, the genetically engineered bacterium is a tumor-targeting bacterium. In some embodiments, the genetically engineered bacterium express one or more single chain antibodies against one or more immune checkpoints, under the control of a promoter that is activated by low-oxygen conditions, by hypoxic conditions, or by inflammatory conditions, such as any of the promoters activated by said conditions and described herein. In some embodiments, the genetically engineered bacteria expresses one or more single chain antibodies against one or more immune checkpoints, under the control of a cancer-specific promoter, a tissue-specific promoter, or a constitutive promoter, such as any of the promoters described herein.

In some embodiments, the genetically engineered microorganism is a tumor-targeting bacterium that expresses a PD-1 inhibitor. In some embodiments, the genetically engineered bacterium expresses a PD-1 inhibitor under the control of a promoter that is activated by low-oxygen conditions, e.g., the hypoxic environment of a tumor. In some embodiments, the genetically engineered microorganism is a tumor-targeting bacterium that expresses a PD-1 inhibitor under the control of a promoter that is activated by low-oxygen conditions, e.g., the hypoxic environment of a tumor. In some embodiments, the genetically engineered bacterium expresses an anti-PD-1 antibody, e.g., single chain antibody. In some embodiments, the genetically engineered bacterium is a tumor-targeting bacterium that expresses an anti-PD-1 antibody, e.g., single chain antibody. In some embodiments, the genetically engineered bacterium expresses an anti-PD-1 antibody, e.g., single chain antibody, under the control of a promoter that is activated by low-oxygen conditions. In some embodiments, the genetically engineered bacterium is a tumor-targeting bacterium that expresses an anti-PD-1 antibody, e.g., single chain antibody, under the control of a promoter that is activated by low-oxygen conditions.

In some embodiments, the nucleic acid encoding an scFv construct, e.g., a PD1-scFv, comprises a sequence which has at least about 80%, at least about 85%, at least about 90%, at least about 95%, or at least about 99% homology to a sequence selected from SEQ ID NO: 975, SEQ ID NO: 976, SEQ ID NO: 977, SEQ ID NO: 978, SEQ ID NO: 979, and/or SEQ ID NO: 980. In some embodiments, the nucleic acid encoding an scFv construct, e.g., a PD1-scFv, comprises a sequence selected from SEQ ID NO: 975, SEQ ID NO: 976, SEQ ID NO: 977, SEQ ID NO: 978, SEQ ID NO: 979, and/or SEQ ID NO: 980. In some embodiments, the nucleic acid encoding an scFv construct, e.g., a PD1-scFv, consists of a sequence selected from SEQ ID NO: 975, SEQ ID NO: 976, SEQ ID NO: 977, SEQ ID NO: 978, SEQ ID NO: 979, and/or SEQ ID NO: 980.

In some embodiments, the genetically engineered bacterium expresses a PD-L1 inhibitor. In some embodiments, the genetically engineered bacterium expresses an anti-PD-L1 antibody, e.g., single chain antibody. In some embodiments, the genetically engineered bacterium is a tumor-targeting bacterium that expresses an anti-PD-L1 antibody, e.g., single chain antibody. In some embodiments, the genetically engineered bacterium is a tumor-targeting bacterium that expresses an anti-PD-L1 antibody, e.g., single chain antibody under the control of a promoter that is activated by low-oxygen conditions.

In some embodiments, the genetically engineered bacterium is a tumor-targeting bacterium that expresses an PD-L2 inhibitor. In some embodiments, the genetically engineered bacterium is a tumor-targeting bacterium that expresses an anti-PD-L2 antibody, e.g., single chain antibody. In some embodiments, the genetically engineered bacterium is a tumor-targeting bacterium that expresses an anti-PD-L2 antibody, e.g., single chain antibody. In some embodiments, the genetically engineered bacterium is a tumor-targeting bacterium that expresses an anti-PD-L2 antibody, e.g., single chain antibody under the control of a promoter that is activated by low-oxygen conditions.

In any of these embodiments, the anti-immune checkpoint antibody can be a single chain antibody. In any of these embodiments, the genetically engineered bacterium is a tumor-targeting bacterium. In some embodiments, the genetically engineered bacterium express one or more single chain antibodies against one or more immune checkpoints, under the control of a promoter that is activated by low-oxygen conditions, by hypoxic conditions, or by inflammatory conditions, such as any of the promoters activated by said conditions and described herein. In some embodiments, the genetically engineered bacteria expresses one or more single chain antibodies against one or more immune checkpoints, under the control of a cancer-specific promoter, a tissue-specific promoter, or a constitutive promoter, such as any of the promoters described herein.

Thus, in certain embodiments, the genetically engineered bacteria produces an anti-cancer molecule that inhibits LAG3, for example, the genetically engineered microorganism may encode an antibody directed against LAG-3, e.g. a single-chain antibody against LAG-3. In some embodiments, the genetically engineered bacterium is a tumor-targeting bacterium that expresses an anti-LAG-3 antibody, e.g., single chain antibody. In some embodiments, the genetically engineered bacterium expresses an anti-LAG-3 antibody, e.g., single chain antibody, under the control of a promoter that is activated by low-oxygen conditions. In some embodiments, the genetically engineered bacterium express an anti-LAG-3 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-LAG-3 antibody, e.g., single chain antibody, under the control of a cancer-specific promoter, a tissue-specific promoter, or a constitutive promoter, such as any of the promoters described herein.

TIGIT is expressed by subsets of regulatory and memory CD4+ T cells, CD8+ T cells, and natural killer cells. TIGIT modulates natural killer cell killing and CD4+ T cell activation and promotes tolerance by increasing interleukin 10 (IL-10) while suppressing IL-12 production by dendritic cells. Thus, in certain embodiments, the genetically engineered bacteria produce an anti-cancer molecule that inhibits TIGIT, for example, the genetically engineered microorganism may encode an antibody directed against TIGIT, e.g. a single-chain antibody against TIGIT. In some embodiments, the genetically engineered bacterium is a tumor-targeting bacterium that expresses an anti-TIGIT antibody, e.g., single chain antibody. In some embodiments, the genetically engineered bacterium expresses an anti-TIGIT antibody, e.g., single chain antibody, under the control of a promoter that is activated by low-oxygen conditions. In some embodiments, the genetically engineered bacterium is a tumor-targeting bacteria that expresses an anti-TIGIT antibody, e.g., single chain antibody, under the control of a promoter that is activated by low-oxygen conditions. In some embodiments, the genetically engineered bacteria express an anti-TIGIT antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-TIGIT antibody, e.g., single chain antibody, under the control of a cancer-specific promoter, a tissue-specific promoter, or a constitutive promoter, such as any of the promoters described herein.

V-domain immunoglobulin (Ig)-containing suppressor of T-cell activation (VISTA) is an immune checkpoint that is a potent negative regulator of T-cell function that is predominantly expressed on hematopoietic cells. VISTA is found at high levels on myeloid cells that infiltrated tumors in multiple murine cancer models. VISTA suppresses T-cell activation, induces Foxp3 expression, and is highly expressed within the tumor microenvironment. Its blockade can enhance antitumor immune responses in mice by improving T-cell responses, resulting in slowed tumor growth. Thus, in certain embodiments, the genetically engineered bacteria produce an anti-cancer molecule that inhibits VISTA, for example, the genetically engineered microorganism may encode an antibody directed against VISTA, e.g. a single-chain antibody against VISTA. In some embodiments, the genetically engineered bacterium is a tumor-targeting bacterium that expresses an anti-VISTA antibody, e.g., single chain antibody. In some embodiments, the genetically engineered bacterium expresses an anti-VISTA antibody, e.g., single chain antibody, under the control of a promoter that is activated by low-oxygen conditions. In some embodiments, the genetically engineered bacterium is a tumor-targeting bacteria that expresses an anti-VISTA antibody, e.g., single chain antibody, under the control of a promoter that is activated by low-oxygen conditions. In some embodiments, the genetically engineered bacterium express an anti-VISTA antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-VISTA antibody, e.g., single chain antibody, under the control of a cancer-specific promoter, a tissue-specific promoter, or a constitutive promoter, such as any of the promoters described herein.

B7-H3, or CD276, is an immune checkpoint molecule that belongs to the B7/CD28 superfamily. B7-H3 down-modulates human T-cell responses, e.g., decreases T cell proliferation and cytokine production in naïve as well as pre-activated T cells. B7-H3 expression has been reported in several human cancers, indicating a role for B7-H3 as a regulator of antitumor immunity. For example, Additionally, tumor B7-H3 expression is correlated with poor patient survival in a number of different tumor types, including in clear cell renal cell carcinoma, urothelial cell carcinoma, ovarian cancer, glioblastoma, osteosarcoma, pancreatic cancer, and neuroblastoma, as well as other solid tumors. The discovery of B7-H3 on tumor vasculature has further expanded its utility as a cancer immunotherapy target. Thus, in certain embodiments, the genetically engineered bacteria produce an anti-cancer molecule that inhibits B7-H3, for example, the genetically engineered microorganism may encode an antibody directed against B7-H3, e.g. a single-chain antibody against B7-H3. In some embodiments, the genetically engineered bacterium is a tumor-targeting bacterium that expresses an anti-B7-H3 antibody, e.g., single chain antibody. In some embodiments, the genetically engineered bacterium expresses an anti-B7-H3 antibody, e.g., single chain antibody, under the control of a promoter that is activated by low-oxygen conditions. In some embodiments, the genetically engineered bacterium is a tumor-targeting bacteria that expresses an anti-B7-H3 antibody, e.g., single chain antibody, under the control of a promoter that is activated by low-oxygen conditions. In some embodiments, the genetically engineered bacterium express an anti-B7-H3 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-B7-H3 antibody, e.g., single chain antibody, under the control of a cancer-specific promoter, a tissue-specific promoter, or a constitutive promoter, such as any of the promoters described herein.

Hepatitis A virus cellular receptor 2 (HAVCR2), also known as T-cell immunoglobulin and mucin-domain containing-3 (TIM-3), is a Th1-specific cell surface protein that mediates T-cell exhaustion with other inhibitory receptors including programmed cell death protein 1 (PD1) and lymphocyte activation gene 3 protein (LAGS). TIM3, an immune checkpoint, regulates macrophage activation and may interact with the PD-1 pathway in the dysfunction of CD8+ T cells and Tregs in cancer. Thus, in certain embodiments, the genetically engineered bacteria produce an anti-cancer molecule that inhibits TIM-3, for example, the genetically engineered microorganism may encode an antibody directed against Tim-3, e.g. a single-chain antibody against Tim-3. In some embodiments, the genetically engineered bacterium is a tumor-targeting bacterium that expresses an anti-TIM-3 antibody, e.g., single chain antibody. In some embodiments, the genetically engineered bacterium expresses an anti-TIM-3 antibody, e.g., single chain antibody, under the control of a promoter that is activated by low-oxygen conditions. In some embodiments, the genetically engineered bacterium is a tumor-targeting bacteria that expresses an anti-TIM-3 antibody, e.g., single chain antibody, under the control of a promoter that is activated by low-oxygen conditions. In some embodiments, the genetically engineered bacterium express an anti-TIM-3 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-TIM-3 antibody, e.g., single chain antibody, under the control of a cancer-specific promoter, a tissue-specific promoter, or a constitutive promoter, such as any of the promoters described herein.

Carcinoembryonic antigen-related cell adhesion molecule 1 (biliary glycoprotein) (CEACAM1) also known as CD66a (Cluster of Differentiation 66a), is an immune checkpoint which is a human glycoprotein belonging to the immunoglobulin superfamily. It functions as a cell-cell adhesion molecule detected on leukocytes, epithelia, and endothelia. CEACAM1 plays a role in angiogenesis, apoptosis, tumor suppression, metastasis, and the modulation of innate and adaptive immune responses. In certain embodiments, the genetically engineered bacteria produce an anti-cancer molecule that inhibits CEACAM1, for example, the genetically engineered microorganism may encode an antibody directed against CEACAM1, e.g. a single-chain antibody against CEACAM1. In some embodiments, the genetically engineered bacterium is a tumor-targeting bacterium that expresses an anti-CEACAM1 antibody, e.g., single chain antibody. In some embodiments, the genetically engineered bacterium expresses an anti-CEACAM1 antibody, e.g., single chain antibody, under the control of a promoter that is activated by low-oxygen conditions. In some embodiments, the genetically engineered bacterium is a tumor-targeting bacteria that expresses an anti-CEACAM1 antibody, e.g., single chain antibody, under the control of a promoter that is activated by low-oxygen conditions. In some embodiments, the genetically engineered bacterium express an anti-CEACAM1 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CEACAM1 antibody, e.g., single chain antibody, under the control of a cancer-specific promoter, a tissue-specific promoter, or a constitutive promoter, such as any of the promoters described herein.

Leukocyte-associated immunoglobulin-like receptor 1 (also known as CD305 (cluster of differentiation 305)) is an inhibitory receptor found on peripheral mononuclear cells, including NK cells, T cells, and B cells, that regulates the immune response to prevent lysis of cells recognized as self. Among other things, LAIR-1 can inhibit the cytotoxic activity of effector T cells upon CD3 binding or antigen stimulation, down-regulate Ig and cytokine production, and inhibit cytokine-mediated signals. LAIR-1 also inhibits the differentiation of peripheral blood precursors toward dendritic cells in vitro and GM-CSF-dependent proliferation. In certain embodiments, the genetically engineered bacteria produce an anti-cancer molecule that inhibits LAIR-1, for example, the genetically engineered microorganism may encode an antibody directed against LAIR-1, e.g. a single-chain antibody against LAIR-1. In some embodiments, the genetically engineered bacterium is a tumor-targeting bacterium that expresses an anti-LAIR-1 antibody, e.g., single chain antibody. In some embodiments, the genetically engineered bacterium expresses an anti-LAIR-1 antibody, e.g., single chain antibody, under the control of a promoter that is activated by low-oxygen conditions. In some embodiments, the genetically engineered bacterium is a tumor-targeting bacteria that expresses an anti-LAIR-1 antibody, e.g., single chain antibody, under the control of a promoter that is activated by low-oxygen conditions. In some embodiments, the genetically engineered bacterium express an anti-LAIR-1 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-LAIR-! antibody, e.g., single chain antibody, under the control of a cancer-specific promoter, a tissue-specific promoter, or a constitutive promoter, such as any of the promoters described herein.

B- and T-lymphocyte attenuator BTLA (also known as CD272) is induced during the activation of T cells. BTLA displays T cell inhibition via interaction with tumor necrosis family receptors (TNF-R). BTLA is a ligand for tumournecrosis factor (receptor) superfamily, member 14 (TNFRSF14), also known as herpes virus entry mediator (HVEM). CD160 is also a ligand for HVEM, which binding delivers a coinhibitory signal. BTLA-HVEM complexes negatively regulate T-cell immune responses. In certain embodiments, the genetically engineered bacteria produce an anti-cancer molecule that inhibits the binding of BTLA or CD160 to HVEM. In certain embodiments, the genetically engineered bacteria produce an anti-cancer molecule that inhibits BLTA and/or an anti-cancer molecule that inhibits CD160 and/or an anti-cancer molecule that inhibits HVEM, for example, the genetically engineered microorganism may encode an antibody directed against BTLA and/or an antibody directed against CD160, and/or an HVEM antagonist (antagonist ligand or antibody), e.g. a single-chain antibody against BTLA and/or a single-chain antibody against CD160 and/or a single-chain antagonistic antibody against HVEM. In some embodiments, the genetically engineered bacterium is a tumor-targeting bacterium that expresses an anti-BTLA antibody and/or an anti-CD160 antibody and/or an HVEM antagonist, e.g., a single chain antibody. In some embodiments, the genetically engineered bacterium expresses an anti-BTLA antibody and/or an anti-CD160 antibody and/or HVEM antagonist, e.g., single chain antibody, under the control of a promoter that is activated by low-oxygen conditions. In some embodiments, the genetically engineered bacterium is a tumor-targeting bacteria that expresses an anti-BTLA antibody, and/or an anti-CD160 antibody, and/or an HVEM antagonist, e.g., single chain antibody, under the control of a promoter that is activated by low-oxygen conditions. In some embodiments, the genetically engineered bacterium express an anti-BTLA antibody and/or an anti-CD160 antibody and/or HVEM antagonist, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-BTLA antibody and/or an anti-CD160 antibody and/or HVEM antagonist, e.g., single chain antibody, under the control of a cancer-specific promoter, a tissue-specific promoter, or a constitutive promoter, such as any of the promoters described herein.

OX-2 membrane glycoprotein, also named CD200 (Cluster of Differentiation 200), is a type-1 membrane glycoprotein which, upon binding to CD200R1, regulates myeloid cell activity and delivers an inhibitory signal for the macrophage lineage in diverse tissues. CD200 receptor binding induces the plasmacytoid subset of splenic DCs (pDCs) to express the enzyme IDO, which initiates a tolerogenic pathway of tryptophan catabolism capable of suppressing antigen-specific responses in vivo. In peritoneal macrophages, IFNγ and IL-17-stimulated cytokine secretion is inhibited by CD200R1 engagement. CD200R1 engagement on monocytes also inhibits the secretion of IL-5 and IL-13 from human PBMCs. In certain embodiments, the genetically engineered bacteria produce an anti-cancer molecule that inhibits the binding of CD200 to CD200R1. In certain embodiments, the genetically engineered bacteria produce an anti-cancer molecule that inhibits CD200 and/or an anti-cancer molecule that inhibits CD200R1, for example, the genetically engineered microorganism may encode an antibody directed against CD200 and/or an antibody directed against CD200R1, e.g. a single-chain antibody against CD200 and/or a single chain antibody against CD200R1. In some embodiments, the genetically engineered bacterium is a tumor-targeting bacterium that expresses an anti-CD200 antibody and/or an anti-CD200R1 antibody, e.g., a single chain antibody. In some embodiments, the genetically engineered bacterium expresses an anti-CD200 antibody and/or an anti-CD200R1 antibody, e.g., single chain antibody, under the control of a promoter that is activated by low-oxygen conditions. In some embodiments, the genetically engineered bacterium is a tumor-targeting bacteria that expresses an anti-CD200 and/or anti-CD200R1 antibody, e.g., single chain antibody, under the control of a promoter that is activated by low-oxygen conditions. In some embodiments, the genetically engineered bacterium express an anti-CD200 antibody and/or an anti-CD200R1 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CD200 antibody and/or an anti-CD200R1 antibody, e.g., single chain antibody, under the control of a cancer-specific promoter, a tissue-specific promoter, or a constitutive promoter, such as any of the promoters described herein.

KIR (killer cell immunoglobulin-like receptor) is a receptor found on natural killer (NK) cells, which functions as an immune checkpoint. The interaction of KIR with tumor ligands (e.g., HLAC) down-regulates NK cytotoxic activity and also mediates tolerance and reduces graft versus host disease in allogenic stem cell transplantation. KIR has been found to be immunosuppressive in lung cancer cells. In certain embodiments, the genetically engineered bacteria produce an anti-cancer molecule that inhibits KIR, for example, the genetically engineered microorganism may encode an antibody directed against KIR, e.g. a single-chain antibody against KIR. In some embodiments, the genetically engineered bacterium is a tumor-targeting bacterium that expresses an anti-KIR antibody, e.g., a single chain antibody. In some embodiments, the genetically engineered bacterium expresses an anti-KIR antibody, e.g., single chain antibody, under the control of a promoter that is activated by low-oxygen conditions. In some embodiments, the genetically engineered bacterium is a tumor-targeting bacteria that expresses an anti-KIR antibody, e.g., single chain antibody, under the control of a promoter that is activated by low-oxygen conditions. In some embodiments, the genetically engineered bacterium express an anti-KIR antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-KIR antibody, e.g., single chain antibody, under the control of a cancer-specific promoter, a tissue-specific promoter, or a constitutive promoter, such as any of the promoters described herein.

Adenosine, acting via the A2A adenosine receptor (A2aR), is emerging as an important inhibitor of immune function. Studies have demonstrated the ability of A2a receptor blockade to enhance tumor vaccines, checkpoint blockade and adoptive T cell therapy. In certain embodiments, the genetically engineered bacteria produce an anti-cancer molecule that inhibits A2aR, for example, the genetically engineered microorganism may encode an antibody directed against A2aR, e.g. a single-chain antibody against A2aR. In some embodiments, the genetically engineered bacterium is a tumor-targeting bacterium that expresses an anti-A2aR antibody, e.g., a single chain antibody. In some embodiments, the genetically engineered bacterium expresses an anti-A2aR antibody, e.g., single chain antibody, under the control of a promoter that is activated by low-oxygen conditions. In some embodiments, the genetically engineered bacterium is a tumor-targeting bacteria that expresses an anti-A2aR antibody, e.g., single chain antibody, under the control of a promoter that is activated by low-oxygen conditions. In some embodiments, the genetically engineered bacterium express an anti-A2aR antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-A2aR antibody, e.g., single chain antibody, under the control of a cancer-specific promoter, a tissue-specific promoter, or a constitutive promoter, such as any of the promoters described herein.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 755, SEQ ID NO: 756, SEQ ID NO: 757, SEQ ID NO: 758, SEQ ID NO: 759, and/or SEQ ID NO: 760.

Exemplary heavy and light chain amino acid sequences for use in constructing single-chain anti-CTLA-4 antibodies are shown are described herein (e.g., SEQ ID NO: 761, SEQ ID NO: 762, SEQ ID NO: 763, SEQ ID NO: 764).

Exemplary heavy and light chain amino acid sequences for use in constructing single-chain anti-PD-1 antibodies include SEQ ID NO: 1, SEQ ID NO: 2, SEQ ID NO: 3, and/or SEQ ID NO: 4.

In some embodiments, the sequence is at least about 80%, at least about 85%, at least about 90%, at least about 95%, or at least about 99% homologous to the sequence of SEQ ID NO: 1, SEQ ID NO: 2, SEQ ID NO: 3, and/or SEQ ID NO: 4. Other exemplary heavy and light chain amino acid sequences for construction of single chain antibodies include SEQ ID NO: 5-46.

In some embodiments, the single chain antibody is at least about 80%, at least about 85%, at least about 90%, at least about 95%, or at least about 99% homologous to the sequence of SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44 SEQ ID NO:45, or SEQ ID NO: 46.

In some embodiments, genetically engineered bacteria comprise a nucleic acid sequence that encodes a polypeptide that is at least about 80%, at least about 85%, at least about 90%, at least about 95%, or at least about 99% homologous to the DNA sequence of SEQ ID NO: 1, SEQ ID NO: 2, SEQ ID NO: 3, and/or SEQ ID NO: 4.

Immuno-Metabolism and Metabolic Converters

Tryptophan and Kynurenine

T regulatory cells, or Tregs, are a subpopulation of T cells that modulate the immune system by preventing excessive immune reactions, maintaining tolerance to self-antigens, and abrogating autoimmunity. Tregs suppress the immune responses of other cells, for example, shutting down immune responses after they have successfully eliminated invading organisms. These cells generally suppress or downregulate induction and proliferation of effector T cells.

There are different sub-populations of regulatory T cells, including those that express CD4, CD25, and Foxp3 (CD4+ CD25+ regulatory T cells).

While regulatory T cells are crucial in mediating immune homeostasis, and promoting the establishment and maintenance of peripheral tolerance, they are thought to contribute to the progress of many tumors. Tregs are key to dampening effector T cell responses, and therefore represent one of the main obstacles to effective anti-tumor response and the failure of current therapies that rely on induction or potentiation of anti-tumor responses.

Thus, in certain embodiments, the genetically engineered bacteria of the present disclosure produce one or more anti-cancer molecules that deplete Tregs and/or inhibit or block the activation of Tregs.

The tryptophan (TRP) to kynurenine (KYN) metabolic pathway is established as a key regulator of innate and adaptive immunity. Several preclinical models suggest that this immune tolerance pathway is active in cancer immunity, autoimmunity, infection, transplant rejection, and allergy. Drugs targeting this pathway, e.g., indoleamine-2,3-dioxygenase (IDO), are in clinical trials with the aim at reversing cancer-induced immunosuppression.

The catabolism of the essential amino acid tryptophan is a central pathway maintaining the immunosuppressive microenvironment in many types of cancers. Tumor cells or myeloid cells in the tumor microenvironment express high levels of indoleamine-2,3-dioxygenase 1 (IDO1), which is the first and rate-limiting enzyme in the degradation of tryptophan. This enzymatic activity results in the depletion of tryptophan in the local microenvironment and subsequent inhibition of T cell responses, which results in immunosuppression (as T cells are particularly sensitive to low tryptophan levels). More recent preclinical studies suggest an alternative route of tryptophan degradation in tumors via the enzyme TRP-2,3-dioxygenase 2 (TDO). Thus, tumor cells may express and catabolize tryptophan via TDO instead of or in addition to IDO1.

In addition, several studies have proposed that immunosuppression by tryptophan degradation is not solely a consequence of lowering local tryptophan levels but also of accumulating high levels of tryptophan metabolites. Preclinical studies and analyses of human tumor tissue have demonstrated that T cell responses are inhibited by tryptophan metabolites, primarily by binding to the aryl hydrocarbon receptor (AHR), a cytoplasmic transcription factor. These studies show that binding of the tryptophan metabolite kynurenine to the aryl hydrocarbon receptor results in reprograming the differentiation of naïve CD4+T-helper (Th) cells favoring a regulatory T cells phenotype (Treg) while suppressing the differentiation into interleukin-17 (IL-17)-producing Th (Th17) cells. Activation of the aryl hydrogen receptor also results in promoting a tolerogenic phenotype on dendritic cells.

In some embodiments, the genetically engineered microorganisms of the present disclosure, e.g., genetically engineered bacteria are capable of depleting Tregs or inhibiting or blocking the activation of Tregs by producing tryptophan. In some embodiments, the genetically engineered microorganisms of the present disclosure capable of increasing the CD8+: Treg ratio (e.g., favors the production of CD8+ over Tregs) by producing tryptophan.

Increasing Tryptophan

In some embodiments, the genetically engineered microorganisms of the present disclosure are capable of producing tryptophan. Exemplary circuits for the production of tryptophan are shown in FIG. 6A-6D, FIG. 7, and FIG. 8.

In some embodiments, the genetically engineered bacteria and/or other microorganisms that produce tryptophan comprise one or more gene sequences encoding one or more enzymes of the tryptophan biosynthetic pathway. In some embodiments, the genetically engineered bacteria comprise a tryptophan operon. In some embodiments, the genetically engineered bacteria comprise the tryptophan operon of *E. coli*. (Yanofsky, RNA (2007), 13:1141-1154). In some embodiments, the genetically engineered bacteria comprise the tryptophan operon of *B. subtilis*. (Yanofsky, RNA (2007), 13:1141-1154). In some embodiments, the genetically engineered bacteria comprise sequence(s) encoding trpE, trpG-D, trpC-F, trpB, and trpA genes. In some embodiments, the genetically engineered bacteria comprise sequence(s) encoding trpE, trpG-D, trpC-F, trpB, and trpA genes from *E. coli*. In some embodiments, the genetically engineered bacteria comprise sequence(s) encoding trpE, trpD, trpC, trpF, trpB, and trpA genes from *B. subtilis*. In any of these embodiments, the genetically engineered bacteria and/or other microorganisms optionally comprise gene sequence(s) to produce the tryptophan precursor, chorismate. Thus, in some embodiments, the genetically engineered bacteria optionally comprise sequence(s) encoding aroG, aroF, aroH, aroB, aroD, aroE, aroK, and AroC. In some embodiments, the genetically engineered bacteria comprise one or more gene sequences encoding one or more enzymes of the tryptophan biosynthetic pathway and one or more gene sequences encoding one or more enzymes of the chorismate biosynthetic pathway. In some embodiments, the genetically engineered bacteria comprise sequence(s) encoding trpE, trpG-D, trpC-F, trpB, and trpA genes from *E.*

*coli* and sequence(s) encoding aroG, aroF, aroH, aroB, aroD, aroE, aroK, and AroC genes. In some embodiments, the genetically engineered bacteria comprise sequence(s) encoding trpE, trpD, trpC, trpF, trpB, and trpA genes from *B. subtilis* and sequence(s) encoding aroG, aroF, aroH, aroB, aroD, aroE, aroK, and AroC genes.

In some embodiments, the genetically engineered bacteria comprise sequence(s) encoding either a wild type or a feedback resistant SerA gene. *Escherichia coli* serA-encoded 3-phosphoglycerate (3PG) dehydrogenase catalyzes the first step of the major phosphorylated pathway of L-serine (Ser) biosynthesis. This step is an oxidation of 3PG to 3-phosphohydroxypyruvate (3PHP) with the concomitant reduction of NAD+ to NADH. As part of Tryptophan biosynthesis, *E. coli* uses one serine for each tryptophan produced. Without wishing to be bound by theory, by expressing serA, tryptophan production is improved (see, e.g., FIG. 6A-FIG. 6D)

In any of these embodiments, AroG and TrpE are optionally replaced with feedback resistant versions to improve tryptophan production.

In any of these embodiments, the tryptophan repressor (trpR) optionally may be deleted, mutated, or modified so as to diminish or obliterate its repressor function.

In any of these embodiments, the tnaA gene (encoding a tryptophanase converting Trp into indole) optionally may be deleted to prevent tryptophan catabolism along this pathway and to further increase levels of tryptophan produced.

In any of these embodiments, the pheA gene may optionally be deleted.

The inner membrane protein YddG of *Escherichia coli*, encoded by the yddG gene, is a homologue of the known amino acid exporters RhtA and YdeD. Studies have shown that YddG is capable of exporting aromatic amino acids, including tryptophan. Thus, YddG c an function as a tryptophan exporter or a tryptophan secretion system (or tryptophan secretion protein). Other aromatic amino acid exporters are described in Doroshenko et al., FEMS Microbial Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

In one specific embodiment, tryptophan is produced from the chorismate precursor through expression of the trpE, trpG-D, trpC-F, trpB and trpA genes. AroG and TrpE are replaced with feedback resistant versions to improve tryptophan production. The strain optionally further comprises either a wild type or a feedback resistant SerA gene. In one embodiment, strain comprises a feedback resistant SerA gene. In this specific embodiment, trpR and TnaA are deleted.

Exemplary tryptophan synthesis cassettes encoded by the genetically engineered bacteria and/or other microorganisms of the disclosure include SEQ ID NO 47-54. Exemplary Tryptophan Biosynthesis Enzyme Sequences include SEQ ID NO: 55-59

In some embodiments, the tryptophan biosynthesis enzyme or cassette is at least about 80%, at least about 85%, at least about 90%, at least about 95%, or at least about 99% homologous to the sequence of SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, and/or SEQ ID NO: 59.

Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 47 through SEQ ID NO: 59. In another embodiment, one or more polynucleotides and/or polypeptides encoded and expressed by the genetically engineered bacteria comprise the sequence of one or more of SEQ ID NO: 47 through SEQ ID NO: 59. In another embodiment, one or more polynucleotides and/or polypeptides encoded and expressed by the genetically engineered bacteria consist of the sequence of one or more of SEQ ID NO: 47 through SEQ ID NO: 59.

Exemplary polypeptide sequences feedback resistant AroG and TrpE are shown in SEQ ID NO: 60 and 61. Table 15. Wild type and Feedback resistant AroG and TrpE, SerA and tryptophanase sequences include SEQ ID NO: 60-64.

In one embodiment, one or more polypeptides encoded and expressed by the genetically engineered bacteria have at least about 80% identity with one or more of SEQ ID NO: 60 through SEQ ID NO: 63. In one embodiment, one or more polypeptides encoded and expressed by the genetically engineered bacteria have at least about 85% identity with one or more of SEQ ID NO: 60 through SEQ ID NO: 63. In one embodiment, one or more polypeptides encoded and expressed by the genetically engineered bacteria have at least about 90% identity with one or more of SEQ ID NO: 60 through SEQ ID NO: 63. In one embodiment, one or more polypeptides and/or polynucleotides encoded and expressed by the genetically engineered bacteria have at least about 95% identity with one or more of SEQ ID NO: 60 through SEQ ID NO: 63. In one embodiment, one or more polypeptides and/or polynucleotides encoded and expressed by the genetically engineered bacteria have at least about 96%, 97%, 98%, or 99% identity with one or more of SEQ ID NO: 60 through SEQ ID NO: 63. Accordingly, in one embodiment, one or more polypeptides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 60 through SEQ ID NO: 63. In another embodiment, one or more polynucleotides and/or polypeptides encoded and expressed by the genetically engineered bacteria comprise the sequence of one or more of SEQ ID NO: 60 through SEQ ID NO: 63. In another embodiment, one or more polypeptides encoded and expressed by the genetically engineered bacteria consist of the sequence of one or more of SEQ ID NO: 60 through SEQ ID NO: 63.

In some embodiments, the endogenous TnaA polypeptide comprising SEQ ID NO: 64 is mutated or deleted.

In some embodiments, one or more genes for producing tryptophan are modified and/or mutated, e.g., to enhance stability, increase tryptophan production.

In some embodiments, the genetically engineered bacteria are capable of expressing any one or more of the described circuits in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacterial expansion, production and/or manufacture, as described herein.

In some embodiments, any one or more of the described circuits are present on one or more plasmids (e.g., high copy or low copy) or are integrated into one or more sites in the bacterial chromosome. Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein and (8) combinations of one or more of such additional circuits. In any of these embodiments, the genetically engineered bacteria may be administered alone or in combination with one or more immune checkpoint inhibitors described herein, including but not limited to anti-CTLA4 antibodies, anti-PD1 and/or anti-PDL1 antibodies.

Decreasing Kynurenine

As discussed above, studies have shown that the binding of kynurenine to the aryl hydrocarbon receptor results in the production of regulatory T cells (Tregs). In some embodiments, the genetically engineered bacteria and/or other microorganisms comprise a mechanism for metabolizing or degrading kynurenine, and reducing kynurenine levels in the extracellular environment. In some embodiments, the genetically engineered bacteria and/or other microorganisms comprise gene sequence(s) encoding kynureninase.

In one embodiments, the genetically engineered micororganisms encode gene sequences for the expression of kynureninase from *Pseudomonas fluorescens*, which converts kynurenine to AA (Anthranillic acid), which then can be converted to tryptophan through the enzymes of the *E. coli* trp operon. Optionally, the trpE gene may be deleted as it is not needed for the generation of tryptophan from kynurenine. Accordingly, in one embodiment, the genetically engineered bacteria may comprise one or more gene(s) or gene cassette(s) encoding trpD, trpC, trpA, and trpD and kynureninase. This deletion may prevent tryptophan production through the endogenous chorismate pathway, and may increase the production of tryptophan from kynurenine through kynureninase.

In alternate embodiments, the trpE gene is not deleted, in order to maximize tryptophan production by using both kynurenine and chorismate as a substrate. In one embodiment of the invention, the genetically engineered bacteria and/or other microorganisms comprising this circuit may be useful for reducing immune escape in cancer.

In some embodiments, the microorganisms encode a transporter for the uptake of kynurenine from the extracellular environment, e.g., the tumor environment. AroT, located between chr and the trp operon in *Salmonella typhimurium*, and similar genes, aroR and aroS, near the trp locus of *Escherichia coli*, were found to be involved in the transport of aromatic amino acids. AroP is a permease that is involved in the transport across the cytoplasmic membrane of the aromatic amino acids (phenylalanine, tyrosine, and tryptophan). Expression of such transporters/permeases may be useful for kynurenine import in the genetically engineered microorganisms.

Exemplary genes encoding kynureninase which are encoded by the genetically engineered bacteria of the disclosure in certain embodiments include SEQ ID NO: 65-67

In one embodiment, one or more polypeptides and/or polynucleotides encoded and expressed by the genetically engineered bacteria have at least about 80% identity with one or more of SEQ ID NO: 65 through SEQ ID NO: 67. In one embodiment, one or more polypeptides and/or polynucleotides encoded and expressed by the genetically engineered bacteria have at least about 85% identity with one or more of SEQ ID NO: 65 through SEQ ID NO: 67. In one embodiment, one or more polypeptides and/or polynucleotides encoded and expressed by the genetically engineered bacteria have at least about 90% identity with one or more of SEQ ID NO: 65 through SEQ ID NO: 67. In one embodiment, one or more polypeptides and/or polynucleotides encoded and expressed by the genetically engineered bacteria have at least about 95% identity with one or more of SEQ ID NO: 65 through SEQ ID NO: 67. In one embodiment, one or more polypeptides and/or polynucleotides encoded and expressed by the genetically engineered bacteria have at least about 96%, 97%, 98%, or 99% identity with one or more of SEQ ID NO: 65 through SEQ ID NO: 67. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 65 through SEQ ID NO: 67. In another embodiment, one or more polynucleotides and/or polypeptides encoded and expressed by the genetically engineered bacteria comprise the sequence of one or more of SEQ ID NO: 65 through SEQ ID NO: 67. In another embodiment, one or more polynucleotides and/or polypeptides encoded and expressed by the genetically engineered bacteria consist of the sequence of one or more of SEQ ID NO: 65 through SEQ ID NO: 67.

Exemplary codon-optimized kynureninase cassette sequences include SEQ ID NO: 68, 865, 69, 866, 70, 867. In one embodiment, one or more polynucleotides encoded and expressed by the genetically engineered bacteria have at least about 80% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 85% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 90% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 95% identity with one or more of SEQ ID NO: 68 through SEQ ID NO: 70 and SEQ ID NO: 865 through SEQ ID NO: 868. In one embodiment, one or more polynucleotides encoded and expressed by the genetically engineered bacteria have at least about 96%, 97%, 98%, or 99% identity with one or more of SEQ ID NO: 68 through SEQ ID NO: 70 and SEQ ID NO: 865 through SEQ ID NO: 868. Accordingly, in one embodiment, one or more polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 68 through SEQ ID NO: 70 and SEQ ID NO: 865 through SEQ ID NO: 868. In another embodiment, one or more polynucleotides encoded and expressed by the genetically engineered bacteria comprise the sequence of one or more of SEQ ID NO: 68 through SEQ ID NO: 70 and SEQ ID NO: 865 through SEQ ID NO: 868. In another embodiment, one or more polynucleotides encoded and expressed by the genetically engineered bacteria consists of the sequence of one or more of SEQ ID NO: 68 through SEQ ID NO: 70 and SEQ ID NO: 865 through SEQ ID NO: 868.

In some embodiments, the construct for expression of *Pseudomonas fluorescens* Kynureninase is at least about 80%, at least about 85%, at least about 90%, at least about 95%, or at least about 99% homologous to a sequence selected from SEQ ID NO: 116, SEQ ID NO: 888, SEQ ID NO: 889, SEQ ID NO: 890, SEQ ID NO: 891, SEQ ID NO: 892, and/or SEQ ID NO: 893. In some embodiments, the construct for expression of *Pseudomonas fluorescens* Kynureninase comprises a sequence selected from SEQ ID NO: 116, SEQ ID NO: 888, SEQ ID NO: 889, SEQ ID NO: 890, SEQ ID NO: 891, SEQ ID NO: 892, and/or SEQ ID NO: 893. In some embodiments, the construct for expression of *Pseudomonas fluorescens* Kynureninase consists of a sequence selected from SEQ ID NO: 116, SEQ ID NO: 888, SEQ ID NO: 889, SEQ ID NO: 890, SEQ ID NO: 891, SEQ ID NO: 892, and/or SEQ ID NO: 893. Other suitable kynureninases are described in US Patent Publication 20170056449, the contents of which is herein incorporated by reference in its entirety.

In some embodiments, the kynureninase is secreted into the extracellular environment, e.g., tumor microenvironment, using a secretion system described herein.

The genetically engineered bacteria and/or other microorganisms may comprise any suitable gene for producing kynureninase. In some embodiments, the gene for producing kynureninase is modified and/or mutated, e.g., to enhance stability, increase kynureninase production. In some embodiments, the engineered bacteria and/or other microorganisms also have enhanced uptake or import of kynurenine, e.g., comprise a transporter or other mechanism for increasing the uptake of kynurenine into the bacteria and/or other microorganisms cell. In some embodiments, the genetically engineered bacteria and/or other microorganisms are capable of producing kynureninase under inducing conditions, e.g., under a condition(s) associated with immune suppression and/or tumor microenvironment. In some embodiments, the genetically engineered bacteria and/or other microorganisms are capable of producing kynureninase in low-oxygen conditions, in the presence of certain molecules or metabolites, in the presence of molecules or metabolites associated with cancer, or certain tissues, immune suppression, or inflammation, or in the presence of some other metabolite that may or may not be present in the gut or the tumor, such as arabinose.

In some embodiments, the genetically engineered bacteria and/or other microorganisms are capable of expressing any one or more of the described circuits in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut or the tumor, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacteria and/or other microorganismal expansion, production and/or manufacture, as described herein.

In some embodiments, any one or more of the described circuits are present on one or more plasmids (e.g., high copy or low copy) or are integrated into one or more sites in the bacteria and/or other microorganismal chromosome. Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein and (8) combinations of one or more of such additional circuits In any of these embodiments, the genetically engineered bacteria may be administered alone or in combination with one or more immune checkpoint inhibitors described herein, including but not limited anti-CTLA4, anti-PD1, or anti-PD-L1 antibodies.

Increasing Tryptophan and Deceasing Kynurenine

In some embodiments, the genetically engineered bacteria and/or other microorganisms comprise a mechanism for metabolizing or degrading kynurenine, which, in some embodiments, also results in the increased production of tryptophan. In some embodiments, the genetically engineered bacteria modulate the TRP:KYN ratio or the KYN:TRP ratio in the extracellular environment. In some embodiments, the genetically engineered bacteria increase the TRP:KYN ratio or the KYN:TRP ratio. In some embodiments, the genetically engineered bacteria reduce the TRP:KYN ratio or the KYN:TRP ratio. In some embodiments, the genetically engineered bacteria comprise sequence encoding the enzyme kynureninase. Kynureninase is produced to metabolize Kynurenine to Anthranilic acid in the cell. Schwarcz et al., Nature Reviews Neuroscience, 13, 465-477; 2012; Chen & Guillemin, 2009; 2; 1-19; Intl. J. Tryptophan Res. In some embodiments, the engineered microbe has a mechanism for importing (transporting) kynurenine from the local environment into the cell. In some embodiments, the genetically engineered bacteria comprise one or more copies of aroP, tnaB or mtr gene. In some embodiments, the genetically engineered bacteria comprise gene sequence(s) encoding a kynureninase secreter.

In some embodiments, the genetically engineered bacteria comprise gene sequence(s) encoding enzymes of the tryptophan biosynthetic pathway and sequence encoding kynureninase. In some embodiments, the genetically engineered bacteria comprise a tryptophan operon, for example that of E. coli. or B. subtilis, and sequence encoding kynureninase. In some embodiments, the genetically engineered bacteria comprise sequence(s) encoding trpE, trpG-D, trpC-F, trpB, and trpA genes, for example, from E. coli and sequence encoding kynureninase. In some embodiments, the genetically engineered bacteria comprise sequence(s) encoding trpE, trpD, trpC, trpF, trpB, and trpA genes, for example from B. subtilis and sequence encoding kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, for example, sequence(s) encoding aroG, aroF, aroH, aroB, aroD, aroE, aroK, and AroC. Thus, in some embodiments, the genetically engineered bacteria comprise sequence(s) encoding trpE, trpG-D, trpC-F, trpB, and trpA genes from E. coli, sequence(s) encoding aroG, aroF, aroH, aroB, aroD, aroE, aroK, and AroC genes, and sequence encoding kynureninase. In some embodiments, the genetically engineered bacteria comprise sequence(s) encoding trpE, trpD, trpC, trpF, trpB, and trpA genes from B. subtilis, sequence(s) encoding aroG, aroF, aroH, aroB, aroD, aroE, aroK, and AroC genes, and sequence encoding kynureninase.

Optionally, the trpE gene may be deleted as it is not needed for the generation of tryptophan from kynurenine. Accordingly, in one embodiment, the genetically engineered bacteria may comprise one or more gene(s) or gene cassette(s) encoding trpD, trpC, trpA, and trpD and kynureninase (see, e.g. FIG. 8. This deletion may prevent tryptophan production through the endogenous chorismate pathway, and may increase the production of tryptophan from kynurenine through kynureninase.

In alternate embodiments, the trpE gene is not deleted, in order to maximize tryptophan production by using both kynurenine and chorismate as a substrate. In one embodiment of the invention, the genetically engineered bacteria comprising this circuit may be useful for reducing immune escape in cancer.

In some embodiments, the genetically engineered bacteria comprise sequence(s) encoding either a wild type or a feedback resistant SerA gene. In any of these embodiments, AroG and TrpE are optionally replaced with feedback resistant versions to improve tryptophan production. In any of these embodiments, the tryptophan repressor (trpR) optionally may be deleted, mutated, or modified so as to diminish or obliterate its repressor function. In any of these embodiments, the tnaA gene (encoding a tryptophanase converting Trp into indole) optionally may be deleted to prevent tryptophan catabolism along this pathway and to further increase levels of tryptophan produced.

In any of these embodiments, the genetically engineered bacterium may further comprise gene sequence for exporting or secreting tryptophan from the cell. Thus, in some embodiments, the engineered bacteria further comprise gene sequence(s) encoding YddG. In some embodiments, the engineered bacteria can over-express YddG, an aromatic amino acid exporter. In some embodiments, the engineered bacteria optionally comprise one or more copies of yddG gene. In any of these embodiments, the genetically engineered bacterium may further comprise gene sequence for importing or transporting kynurenine into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the kynureninase is secreted into the extracellular environment, e.g., tumor microenvironment, using a secretion system described herein, e.g., and are useful for degradation of kynurenine outside of the cell.

In any of these embodiments, the bacteria genetically engineered to consume kynurenine and optionally produce tryptophan consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more kynurenine than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more kynurenine than unmodified bacteria of the same bacterial subtype under the same conditions. In yet another embodiment, the genetically engineered bacteria consume about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more kynurenine than unmodified bacteria of the same bacterial subtype under the same conditions.

In any of these embodiments, the bacteria genetically engineered to consume kynurenine and optionally produce tryptophan produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more tryptophan than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more tryptophan than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more tryptophan than unmodified bacteria of the same bacterial subtype under the same conditions.

In any of these embodiments, the genetically engineered bacteria increase the kynurenine consumption rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45%

45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the genetically engineered bacteria increase the kynurenine consumption rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase the kynurenine consumption rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one embodiment, the genetically engineered bacteria increase the kynurenine consumption by about 80% to 100% relative to unmodified bacteria of the same bacterial subtype under the same conditions, after 4 hours. In one embodiment, the genetically engineered bacteria increase the kynurenine consumption by about 90% to 100% relative to unmodified bacteria of the same bacterial subtype under the same conditions after 4 hours. In one specific embodiment, the genetically engineered bacteria increase the kynurenine consumption by about 95% to 100% relative to unmodified bacteria of the same bacterial subtype under the same conditions, after 4 hours. In one specific embodiment, the genetically engineered bacteria increase the kynurenine consumption by about 99% to 100% relative to unmodified bacteria of the same bacterial subtype under the same conditions, after 4 hours. In yet another embodiment, the genetically engineered bacteria increase the kynurenine consumption by about 10-50 fold after 4 hours. In yet another embodiment, the genetically engineered bacteria increase the kynurenine consumption by about 50-100 fold after 4 hours. In yet another embodiment, the genetically engineered bacteria increase the kynurenine consumption by about 100-500 fold after 4 hours. In yet another embodiment, the genetically engineered bacteria increase the kynurenine consumption by about 500-1000 fold after 4 hours. In yet another embodiment, the genetically engineered bacteria increase the kynurenine consumption by about 1000-5000 fold after 4 hours. In yet another embodiment, the genetically engineered bacteria increase the kynurenine consumption by about 5000-10000 fold after 4 hours. In yet another embodiment, the genetically engineered bacteria increase the kynurenine consumption by about 10000-1000 fold after 4 hours.

In any of these embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, one or more tryptophan production enzymes are secreted into the extracellular environment, e.g., tumor microenvironment, using a secretion system described herein.

The genetically engineered bacteria may comprise any suitable gene for producing kynureninase and tryptophan production. In some embodiments, the genes for producing kynureninase and/or tryptophan production enzymes are modified and/or mutated, e.g., to enhance stability, increase kynurenine consumption and/or tryptophan production. In some embodiments, the engineered bacteria also have enhanced uptake or import of tryptophan or kynurenine, e.g., comprise a transporter or other mechanism for increasing the uptake of tryptophan or kynurenine into the bacterial cell, as discussed in detail above. In some embodiments, the genetically engineered bacteria are capable of producing kynureninase and tryptophan production enzymes under inducing conditions, e.g., under a condition(s) associated with immune suppression or cancer tissue. In some embodiments, the genetically engineered bacteria are capable of producing kynureninase and tryptophan production enzymes in low-oxygen conditions. In some embodiments, the genetically engineered bacteria are capable of producing kynureninase and tryptophan production enzymes in the presence of certain molecules or metabolites, in the presence of molecules or metabolites associated with cancer, certain tissues, immune suppression, or in the presence of some other metabolite that may or may not be present in the gut, such as arabinose.

In some embodiments, the genetically engineered microorganisms are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

ALE

In the tumor microenvironment the amino acid tryptophan (TRP) and its degradation product kynurenine (KYN) play pivotal roles as immunomodulatory signals. Tumors often degrade TRP (which has proinflammatory properties) into KYN, which possesses anti-inflammatory characteristics, thereby promoting evasion from immune surveillance.

E. coli Nissle can be engineered to efficiently import KYN and convert it to TRP. While Nissle does not typically utilize KYN, by introducing the Kynureninase (KYNase) from Pseudomonas fluorescens (kynU) on a medium-copy plasmid under the control of the tetracycline promoter (Ptet) a new strain with this plasmid (Ptet-KYNase) is able to convert L-kynurenine into anthranilate.

E. coli naturally utilizes anthranilate in its TRP biosynthetic pathway. Briefly, the TrpE (in complex with TrpD) enzyme converts chorismate into anthranilate. TrpD, TrpC, TrpA and TrpB then catalyze a five-step reaction ending with the condensation of an indole with serine to form tryptophan. By replacing the TrpE enzyme via lambda-RED recombineering, the subsequent strain of Nissle (AtrpE::Cm) is an auxotroph unable to grow in minimal media without supplementation of TRP or anthranilate. By expressing kynureninase in AtrpE::Cm (KYNase-trpE), this auxotrophy can be alternatively rescued by providing KYN.

Leveraging the growth-limiting nature of KYN in KYNase-trpE, adaptive laboratory evolution was employed to evolve a strain capable of increasingly efficient utilization of KYN. First a lower limit of KYN concentration was established and mutants were evolved by passaging in lowering concentrations of KYN. While this can select for mutants capable of increasing KYN import, the bacterial cells still prefer to utilize free, exogenous TRP. In the tumor environment, dual-therapeutic functions can be provided by depletion of KYN and increasing local concentrations of TRP. Therefore, to evolve a strain which prefers KYN over TRP, a toxic analogue of TRP—5-fluoro-L-tryptophan (ToxTRP)—can be incorporated into the ALE experiment. The resulting best performing strain is then whole genome sequenced in order to deconvolute the contributing mutations. Lambda-RED can be performed in order to reintroduce TrpE, to inactivate Trp regulation (trpR, tyrR, transcriptional attenuators) to up-regulate TrpABCDE expression and increase chorismate production. The resulting strain is now insensitive to external TRP, efficiently converts KYN into TRP, and also now overproduces TRP.

Purinergic System—ATP/Adenosine Metabolism

An important barrier to successful cancer immunotherapy is that tumors employ a number of mechanisms to facilitate immune escape, including the production of anti-inflammatory cytokines, the recruitment of regulatory immune subsets, and the production of immunosuppressive metabolites. One such immunosuppressive pathway is the production of extracellular adenosine, a potent immunosuppressive molecule, by CD73. The purinergic system regulates and refines immune cell functions, such as cell-to-cell interactions, cytokine and chemokine secretion, surface antigen shedding, intracellular pathogen removal, and generating reactive oxygen species. Extracellular ATP, released by damaged or dying cells and bacteria, promotes the recruitment of immune phagocytes and activates P2X7R, a coactivator of the NLRP3 inflammasome, which then triggers the production of proinflammatory cytokines, such as IL-1β and IL-18. The catabolism of extracellular ATP into ADP, AMP and adenosine is controlled by glycosylphosphatidylinositol (GPI-) anchored ectonucleotidases and membrane-bound kinases. CD39 (ecto-nucleoside triphosphate diphosphohydrolase 1, E-NTPDase1) hydrolyzes ATP into AMP, which is then dephosphorylated into adenosine by CD73 (ecto-5'-nucleotidase, Ecto5'NTase). Thus, CD39 and CD73 act in concert to convert proinflammatory ATP into immunosuppressive adenosine. Notably, the activity of CD39 is reversible by the actions of NDP kinase and adenylate kinase, whereas the activity of CD73 is virtually irreversible. Thus, CD73 represents a crucial checkpoint in the conversion of an ATP-driven proinflammatory environment to an anti-inflammatory milieu induced by adenosine. Stated another way, CD73 negatively regulates the proinflammatory effects of extracellular adenosine triphosphate (ATP).

In the tumor setting, CD39 and CD73 generate increased adenosine levels characteristic of the tumor microenvironment. High expression and activity of CD39 and CD73 has been observed in several blood or solid tumors. In addition, CD39- and CD73-expressing cancer exosomes can also raise adenosine levels within the tumor microenvironment. The CD39/CD73 complex participates in the process of tumor immunoescape, by inhibiting the activation, clonal expansion, and homing of tumor-specific T cells (in particular, T helper and cytotoxic T cells), impairing tumor cell killing by cytolytic effector T lymphocytes, and inducing the suppressive capabilities of Treg and Th17 cells, and enhancing the conversion of type 1 macrophages into tumor-promoting type 2 macrophages (reviewed in Antonioli et al., Trends Mol Med. 2013 June; 19(6): 355-367. CD39 and CD73 in immunity and inflammation). Myeloid-derived suppressor cells (MDSCs), also appear to promote tumor growth by a CD39-mediated mechanism.

Beside its immunoregulatory roles, the ectonucleotidase pathway contributes directly to the modulation of cancer cell growth, differentiation, invasion, migration, metastasis, and tumor angiogenesis. Agents targeting these enzymes show anti-tumor efficacy and a favorable tolerability profile in several murine models of malignancy (Anonioli et al., 2013). In some embodiments, the engineered microorganisms of the present disclosure, e.g., engineered bacteria, produce one or more anti-cancer molecules that inhibit the activity of CD39 and/or inhibit the activity of CD73. In certain embodiments, the genetically engineered bacteria produce an anti-cancer molecule that inhibits CD39 and/or an anti-cancer molecule that inhibits CD73, for example, the genetically engineered microorganism may encode an antibody directed against CD39 and/or an antibody directed against CD73, e.g. a single-chain antibody against CD39 and/or a single chain antibody against CD73. In some embodiments, the genetically engineered bacterium is a tumor-targeting bacterium that expresses an anti-CD39 antibody and/or an anti-CD73 antibody, e.g., a single chain antibody. In some embodiments, the genetically engineered bacterium expresses an anti-CD39 antibody and/or an anti-CD73 antibody, e.g., single chain antibody, under the control of a promoter that is activated by low-oxygen conditions. In some embodiments, the genetically engineered bacterium is a tumor-targeting bacteria that expresses an anti-CD39 and/or anti-CD73 antibody, e.g., single chain antibody, under the control of a promoter that is activated by low-oxygen conditions. In some embodiments, the genetically engineered bacterium express an anti-CD39 antibody and/or an anti-CD73 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CD39 antibody and/or an anti-CD73 antibody, e.g., single chain antibody, under the control of a cancer-specific promoter, a tissue-specific promoter, or a constitutive promoter, such as any of the promoters described herein.

In some embodiments, the genetically engineered bacteria comprise a means for removing excess adenosine from the tumor microenvironment. Many bacteria scavenge low concentrations of nucleosides from the environment for synthesis of nucleotides and deoxynucleotides by salvage pathways of synthesis. Additionally, in *Escherichia coli*, nucleosides can be used as the sole source of nitrogen and carbon for growth (Neuhard J, Nygaard P. Biosynthesis and conversion of nucleotides, purines and pyrimidines. In: Neidhardt F C, Ingraham J L, Low K B, Magasanik B, Schaechter M, Umbarger H E, editors. *Escherichia coli* and *Salmonella typhimurium*: Cellular and molecular biology. Washington D.C.: ASM Press; 1987. pp. 445-473). Two evolutionarily unrelated cation-linked transporter families, the Concentrative Nucleoside Transporter (CNT) family and the Nucleoside: H+ Symporter (NHS) family, are responsible for nucleoside uptake (see e.g., Cabrita et al., Biochem. Cell Biol. Vol. 80, 2002. Molecular biology and regulation of nucleoside and nucleobase transporter proteins in eukaryotes and prokaryotes), the contents of which is herein incorporated by reference in its entirety. NupC and NupG, are the transporter family members in *E. coli*. Mutants defective in both the nupC and nupG genes cannot grow with nucleosides as a single carbon source. Both of these transporters are proton-linked but they differ in their selectivity. NupC is a nucleotide transporter of the H+/nucleotide symporter family. NupC pyrimidine nucleoside-H+ transporter mediates symport (i.e., H+-coupled substrate uptake) of nucleosides, particularly pyrimidines. Two known members of the family are found in gram positive and gram-negative bacteria. NupG is capable of transporting a wide range of nucleosides and deoxynucleosides; in contrast, NupC does not transport guanosine or deoxyguanosine. Homologs of NupG from *E. coli* are found in a wide range of eubacteria, including human gut pathogens such as *Salmonella typhimurium*, organisms associated with periodontal disease such as *Porphyromonas gingivalis* and *Prevotella intermedia*, and plant pathogens in the genus *Erwinia* (As described in Vaziri et al., Mol Membr Biol. 2013 March; 30(1-2): 114-128.

Use of molecular modelling to probe the mechanism of the nucleoside transporter NupG, the contents of which is herein incorporated by reference in its entirety). Putative bacterial transporters from the CNT superfamily and transporters from the NupG/XapB family include those listed in the Table 4 and Table 5 below. In addition, codB (GenBank P25525, *Escherichia coli*) was identified based on homology to a yeast transporter family termed the uracil/allantoin transporter family (Cabrita et al., supra).

TABLE 4

Putative CNT family transporters

| Name | GenBank Acc. No. | Organism |
| --- | --- | --- |
| BH1446 | BAB05165 | *Bacillus halodurans* |
| BsNupC | CAA57663 | *B. subtilis* |
| BsyutK | CAB15208 | *B. subtilis* |
| BsyxjA | CAB15938 | *B. subtilis* |
| CcCNT (CC2089) | AAK24060 | *Caulobacter crescentus* |
| (yeiJ) | AAC75222 | *E. coli* |
| (yeiM) | AAC75225 | *E. coli* |
| (HI0519) | AAC22177 | *Haemophilus influenzae* |
| (HP1180) | AAD08224 | *Helicobacter pylori* |
| (SA0600, SAV0645) | BAB41833, BAB56807 | *Staphylococcus aureus* |
| SpNupC | AAK34582 | *Streptococcus pyogenes* |
| (VC2352) | AAF95495 | *Vibrio cholerae* |
| (VC1953) | AAF95101 | *V. cholera* |
| (VCA0179) | AAF96092 | *V. cholera* |

TABLE 5

Bacterial transporters from the NupG/XapB family

| Protein (gene name) | GenBank accession No. | Organism |
| --- | --- | --- |
| 1. yegT | P76417 | *Escherichia coli* |
| 2. NupG | P09452 | *E. coli* |
| 3. XapB | P45562 | *E. coli* |
| 4. (CC1628) | AAK23606 | *Caulobacter crescentus* |

In some embodiments, the genetically engineered bacteria comprise a means for importing adenosine into the engineered bacteria or engineered virus from the tumor microenvironment. In some embodiments, the genetically engineered bacteria comprise sequence for encoding a nucleoside transporter. In some embodiments, the genetically engineered bacteria comprise sequence for encoding an adenosine transporter. In certain embodiments, genetically engineered bacteria comprise sequence for encoding *E. coli* Nucleoside Permease nupG or nupC. In any of these embodiments, the genetically engineered bacterium is a tumor-targeting bacterium. In some embodiments, the genetically engineered bacterium comprises sequence for encoding a nucleoside transporter or an adenosine transporter, e.g., nupG or nupC transporter sequence, under the control of a promoter that is activated by low-oxygen conditions. In some embodiments, the genetically engineered bacterium comprises sequence for encoding a nucleoside transporter or an adenosine transporter, e.g., nupG or nupC transporter sequence, under the control of a promoter that is activated by hypoxic conditions, or by inflammatory conditions, such as any of the promoters activated by said conditions and described herein. In some embodiments, the genetically engineered bacteria comprises sequence for encoding a nucleoside transporter or an adenosine transporter, e.g., nupG or nupC transporter sequence, under the control of a cancer-specific promoter, a tissue-specific promoter, or a constitutive promoter, such as any of the promoters described herein.

Figure 2:
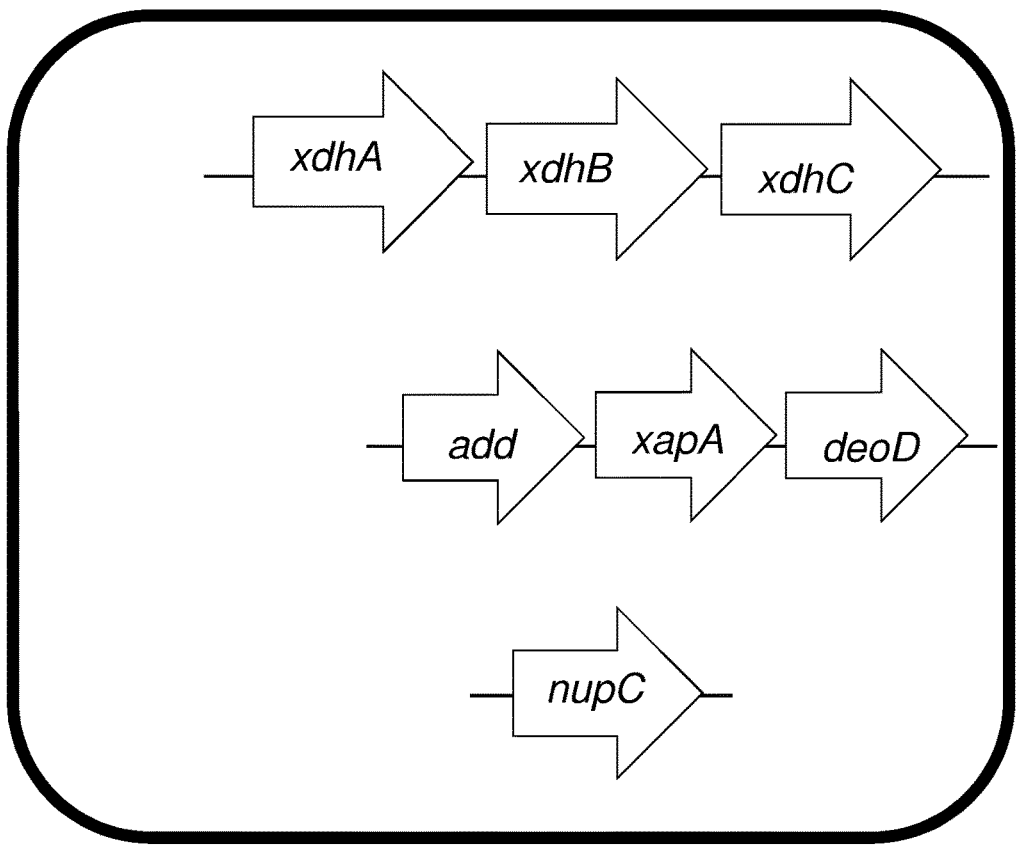
FIG. 2 depicts a schematic showing two exemplary gene organizations of an Adenosine Degradation Circuit. Adenosine is imported into the cell through expression of the E. coli Nucleoside Permease nupC transporter. Alternatively, NupG could be used. Adenosine is converted to Inosine through expression of Adenine Deaminase add. Inosine is converted to hypoxanthine through expression of Inosine Phosphorylase, xapA, and deoD. Hypoxanthine is converted to Xanthine and Urate through expression of Hypoxanthine Hydroxylase, xdhA, xdhB, xdhC. Such circuits can be located one or more plasmids in the microorganism or can be integrated into the chromosome(s). In certain embodiments, the one or more circuits are under the control of inducible promoters known in the art or described herein. For example, such inducible promoters may be induced under low-oxygen conditions, such as an FNR promoter (depicted). In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g., whose expression can be fine-tuned using ribosome binding sites of different strengths. Such microorganisms optionally also comprise an auxotrophy, e.g., deltaThyA or deltaDapA.

In some embodiments, the genetically engineered bacteria comprise a means for metabolizing or degrading adenosine. In some embodiments, the genetically engineered bacteria comprise one or more gene sequences encoding one or more enzymes that are capable of converting adenosine to urate (See FIG. 1, FIG. 2, and FIG. 3). In some embodiments, the genetically engineered bacteria comprise sequence(s) encoding add, xapA, deoD, xdhA, xdhB, and xdhC genes from *E. coli*. In some embodiments, the genetically engineered bacteria comprise sequence(s) encoding add, xapA, deoD, xdhA, xdhB, and xdhC genes from *E. coli* and comprise sequence encoding a nucleoside or adenosine transporter. In some embodiments, the genetically engineered bacteria comprise sequence(s) encoding add, xapA, deoD, xdhA, xdhB, and xdhC genes from *E. coli* and comprise sequence encoding nupG or nupC. An exemplary engineered bacteria is shown in FIG. 2.

Exemplary sequences useful for adenosine degradation circuits include SEQ ID NO: 71-77.

In some embodiments, genetically engineered bacteria comprise a nucleic acid sequence encoding an adenosine degradation enzyme or adenosine transporter that has at least about 80% identity with one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof. In some embodiments, genetically engineered bacteria comprise a nucleic acid sequence encoding an adenosine degradation enzyme or adenosine transporter that has at least about 90% identity with one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof. In some embodiments, genetically engineered bacteria comprise a nucleic acid sequence encoding an adenosine degradation enzyme or adenosine transporter that has at least about 95% identity with one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof. In some embodiments, genetically engineered bacteria comprise a nucleic acid sequence encoding an adenosine degradation enzyme or adenosine transporter that is at least about 80%, at least about 85%, at least about 90%, at least about 95%, or at least about 99% homologous to one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77. In some embodiments, genetically engineered bacteria comprise a nucleic acid sequence encoding an adenosine degradation enzyme or adenosine transporter that comprises one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77. In some embodiments, genetically engineered bacteria comprise a nucleic acid sequence encoding an adenosine degradation enzyme or adenosine transporter that consists of one or more polynucleotide sequences selected from SEQ ID NO: 71, SEQ ID NO: 72, SEQ ID NO: 73, SEQ ID NO: 74, SEQ ID NO: 75, SEQ ID NO: 76, and/or SEQ ID NO: 77.

In some embodiments, genetically engineered bacteria comprise a nucleic acid sequence encoding an adenosine degradation enzyme or adenosine transporter that, but for the redundancy of the genetic code, encodes the same protein as a sequence selected from SEQ ID NO: 71, SEQ ID NO: 72, SEQ ID NO: 73, SEQ ID NO: 74, SEQ ID NO: 75, SEQ ID NO: 76, and/or SEQ ID NO: 77. In some embodiments, the genetically engineered bacteria comprise a nucleic acid encoding an adenosine degradation enzyme or adenosine transporter that, but for the redundancy of the genetic code, encodes a polypeptide that is at least about 80%, to the polypeptide encoded by a sequence selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof.

In some embodiments, the genetically engineered bacteria comprise a nucleic acid encoding an adenosine degradation enzyme or adenosine transporter that, but for the redundancy of the genetic code, encodes a polypeptide that is at least about 90% homologous to the polypeptide encoded by a sequence selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof.

In some embodiments, the genetically engineered bacteria comprise a nucleic acid encoding an adenosine degradation enzyme or adenosine transporter that, but for the redundancy of the genetic code, encodes a polypeptide that is at least about 95%, homologous to the polypeptide encoded by a sequence selected from SEQ ID NO: 71, SEQ ID NO: 72, SEQ ID NO: 73, SEQ ID NO: 74, SEQ ID NO: 75, SEQ ID NO: 76, and/or SEQ ID NO: 77, or a functional fragment thereof. In some embodiments, the genetically engineered bacteria comprise a nucleic acid encoding an adenosine degradation enzyme or adenosine transporter that, but for the redundancy of the genetic code, encodes a polypeptide that is at least about 80%, at least about 85%, at least about 90%, at least about 95%, or at least about 99% homologous to the polypeptide encoded by a sequence selected from SEQ ID NO: 71, SEQ ID NO: 72, SEQ ID NO: 73, SEQ ID NO: 74, SEQ ID NO: 75, SEQ ID NO: 76, and/or SEQ ID NO: 77.

In one specific embodiment, the genetically engineered bacteria comprise PfnrS-nupC integrated into the chromosome at HA1/2 (agaI/rsmI) region, PfnrS-xdhABC, integrated into the chromosome at HA9/10 (exo/cea) region, and PfnrS-add-xapA-deoD integrated into the chromosome at malE/K region.

In some embodiments, constructs comprise PfnrS (SEQ ID NO: 856), PfnrS-nupC (SEQ ID NO: 857), PfnrS-xdhABC (SEQ ID NO: 858), xdhABC (SEQ ID NO: 859), PfnrS-add-xapA-deoD (SEQ ID NO: 860), and add-xapA-deoD (SEQ ID NO: 861).

In some embodiments, genetically engineered bacteria comprise a nucleic acid sequence encoding an adenosine consuming construct that is at least about 80%, at least about 85%, at least about 90%, at least about 95%, or at least about 99% homologous to the a polynucleotide sequence selected from SEQ ID NO: 856, SEQ ID NO: 857, SEQ ID NO: 858, SEQ ID NO: 859, SEQ ID NO: 860, and/or SEQ ID NO: 861, or a variant or functional fragment thereof. In some embodiments, genetically engineered bacteria comprise a nucleic acid sequence encoding an adenosine consuming construct comprising one or more polynucleotide sequence(s) selected from SEQ ID NO: 856, SEQ ID NO: 857, SEQ ID NO: 858, SEQ ID NO: 859, SEQ ID NO: 860, and/or SEQ ID NO: 861. In some embodiments, genetically engineered bacteria comprise a nucleic acid sequence encoding an adenosine consuming construct consisting of one or more a polynucleotide sequence(s) selected from SEQ ID NO: 856, SEQ ID NO: 857, SEQ ID NO: 858, SEQ ID NO: 859, SEQ ID NO: 860, and/or SEQ ID NO: 861.

In some embodiments, genetically engineered bacteria comprise a nucleic acid sequence encoding an NupC. In one embodiment, the nucleic acid sequence encodes a NupC polypeptide, which has at least about 80% identity with SEQ ID NO: 78. In one embodiment, the nucleic acid sequence encodes a NupC polypeptide, which has at least about 90% identity with SEQ ID NO: 78. In another embodiment, the nucleic acid sequence encodes a NupC polypeptide, which has at least about 95% identity with SEQ ID NO: 78. Accordingly, in one embodiment, the nucleic acid sequence encodes a NupC polypeptide, which has at least about 85%, 86%, 87%, 88%, 89%, 90%, 91%, 92%, 93%, 94%, 95%, 96%, 97%, 98%, or 99% identity with SEQ ID NO: 78. In another embodiment, the nucleic acid sequence encodes a NupC polypeptide, which comprises a sequence which encodes SEQ ID NO: 78. In yet another embodiment, the nucleic acid sequence encodes a NupC polypeptide, which consists of SEQ ID NO: 78.

In some embodiments, genetically engineered bacteria comprise a nucleic acid sequence encoding XdhA. In one embodiment, the nucleic acid sequence encodes a XdhA polypeptide, which has at least about 80% identity with SEQ ID NO: 79. In one embodiment, the nucleic acid sequence encodes a XdhA polypeptide, which has at least about 90% identity with SEQ ID NO: 79. In another embodiment, the nucleic acid sequence encodes a XdhA polypeptide, which has at least about 95% identity with SEQ ID NO: 79. Accordingly, in one embodiment, the nucleic acid sequence encodes a XdhA polypeptide, which has at least about 85%, 86%, 87%, 88%, 89%, 90%, 91%, 92%, 93%, 94%, 95%, 96%, 97%, 98%, or 99% identity with SEQ ID NO: 79. In another embodiment, the nucleic acid sequence encodes a XdhA polypeptide, which comprises a sequence which encodes SEQ ID NO: 79. In yet another embodiment, the nucleic acid sequence encodes a XdhA polypeptide, which consists of a sequence which encodes SEQ ID NO: 79.

In some embodiments, genetically engineered bacteria comprise a nucleic acid sequence encoding XdhB. In one embodiment, the nucleic acid sequence encodes a XdhB polypeptide, which has at least about 80% identity with SEQ ID NO: 80. In one embodiment, the nucleic acid sequence encodes a XdhB polypeptide, which has at least about 90% identity with SEQ ID NO: 80. In another embodiment, the nucleic acid sequence encodes a XdhB polypeptide, which has at least about 95% identity with SEQ ID NO: 80. Accordingly, in one embodiment, the nucleic acid sequence encodes a XdhB polypeptide, which has at least about 85%, 86%, 87%, 88%, 89%, 90%, 91%, 92%, 93%, 94%, 95%, 96%, 97%, 98%, or 99% identity with SEQ ID NO: 80. In another embodiment, the nucleic acid sequence encodes a XdhB polypeptide, which comprises a sequence which encodes SEQ ID NO: 80. In yet another embodiment, the nucleic acid sequence encodes a XdhB polypeptide, which consists of a sequence which encodes SEQ ID NO: 80.

In some embodiments, genetically engineered bacteria comprise a nucleic acid sequence encoding XdhC. In one embodiment, the nucleic acid sequence encodes a XdhC polypeptide, which has at least about 80% identity with SEQ ID NO: 81. In one embodiment, the nucleic acid sequence encodes a XdhC polypeptide, which has at least about 90% identity with SEQ ID NO: 81. In another embodiment, the nucleic acid sequence encodes a XdhC polypeptide, which has at least about 95% identity with SEQ ID NO: 81. Accordingly, in one embodiment, the nucleic acid sequence encodes a XdhC polypeptide, which has at least about 85%, 86%, 87%, 88%, 89%, 90%, 91%, 92%, 93%, 94%, 95%, 96%, 97%, 98%, or 99% identity with SEQ ID NO: 81. In another embodiment, the nucleic acid sequence encodes a XdhC polypeptide, which comprises a sequence which encodes SEQ ID NO: 81. In yet another embodiment, the nucleic acid sequence encodes a XdhC polypeptide, which consists of a sequence which encodes SEQ ID NO: 81.

In some embodiments, genetically engineered bacteria comprise a nucleic acid sequence encoding Add. In one embodiment, the nucleic acid sequence encodes a Add polypeptide, which has at least about 80% identity with SEQ ID NO: 82. In one embodiment, the nucleic acid sequence encodes a Add polypeptide, which has at least about 90% identity with SEQ ID NO: 82. In another embodiment, the nucleic acid sequence encodes a Add polypeptide, which has at least about 95% identity with SEQ ID NO: 82. Accordingly, in one embodiment, the nucleic acid sequence encodes a Add polypeptide, which has at least about 85%, 86%, 87%, 88%, 89%, 90%, 91%, 92%, 93%, 94%, 95%, 96%, 97%, 98%, or 99% identity with SEQ ID NO: 82. In another embodiment, the nucleic acid sequence encodes a Add polypeptide, which comprises a sequence which encodes SEQ ID NO: 82. In yet another embodiment, the nucleic acid sequence encodes a Add polypeptide, which consists of a sequence which encodes SEQ ID NO: 82.

In some embodiments, genetically engineered bacteria comprise a nucleic acid sequence encoding XapA. In one embodiment, the nucleic acid sequence encodes a XapA polypeptide, which has at least about 80% identity with SEQ ID NO: 83. In one embodiment, the nucleic acid sequence encodes a XapA polypeptide, which has at least about 90% identity with SEQ ID NO: 83. In another embodiment, the nucleic acid sequence encodes a XapA polypeptide, which has at least about 95% identity with SEQ ID NO: 83. Accordingly, in one embodiment, the nucleic acid sequence encodes a XapA polypeptide, which has at least about 85%, 86%, 87%, 88%, 89%, 90%, 91%, 92%, 93%, 94%, 95%, 96%, 97%, 98%, or 99% identity with SEQ ID NO: 83. In another embodiment, the nucleic acid sequence encodes a XapA polypeptide, which comprises a sequence which encodes SEQ ID NO: 83. In yet another embodiment, the nucleic acid sequence encodes a XapA polypeptide, which consists of a sequence which encodes SEQ ID NO: 83.

In some embodiments, genetically engineered bacteria comprise a nucleic acid sequence encoding DeoD. In one embodiment, the nucleic acid sequence encodes a DeoD polypeptide, which has at least about 80% identity with SEQ ID NO: 84. In one embodiment, the nucleic acid sequence encodes a DeoD polypeptide, which has at least about 90% identity with SEQ ID NO: 84. In another embodiment, the nucleic acid sequence encodes a DeoD polypeptide, which has at least about 95% identity with SEQ ID NO: 84. Accordingly, in one embodiment, the nucleic acid sequence encodes a DeoD polypeptide, which has at least about 85%, 86%, 87%, 88%, 89%, 90%, 91%, 92%, 93%, 94%, 95%, 96%, 97%, 98%, or 99% identity with SEQ ID NO: 84. In another embodiment, the nucleic acid sequence encodes a DeoD polypeptide, which comprises a sequence which encodes SEQ ID NO: 84. In yet another embodiment, the nucleic acid sequence encodes a DeoD polypeptide, which consists of a sequence which encodes SEQ ID NO: 84.

Data described herein suggest anti-tumor activity of adenosine-consuming strains described herein either alone or in combination with an anti-PD1 and/or PD-L1 antibody.

In any of these embodiments, the bacteria genetically engineered to consume adenosine consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more adenosine than unmodified bacteria of the same bacterial subtype under the same conditions. In yet another embodiment, the genetically engineered bacteria consume 1.0-1.2-fold, 1.2-1.4-fold, 1.4-1.6- fold, 1.6-1.8-fold, 1.8-2-fold, or two-fold more adenosine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more adenosine than unmodified bacteria of the same bacterial subtype under the same conditions.

In any of these embodiments, the bacteria genetically engineered to consume adenosine produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more urate than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more urate than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more urate than unmodified bacteria of the same bacterial subtype under the same conditions.

In any of these embodiments, the genetically engineered bacteria increase the adenosine degradation rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the genetically engineered bacteria increase the adenosine degradation rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase the degradation rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In some embodiments, the genetically engineered bacteria have an adenosine degradation rate of about 1.8-10 umol/hr/10^9 cells when induced under low oxygen conditions. In one specific embodiment, the genetically engineered bacteria have an adenosine degradation rate of about 5-9 umol/hr/10^9 cells. In one specific embodiment, the genetically engineered bacteria have an adenosine degradation rate of about 6-8 umol/hr/10^9 cells.

In one embodiment, the genetically engineered bacteria increase the adenosine degradation by about 50% to 70% relative to unmodified bacteria of the same bacterial subtype under the same conditions, i.e., when induced under low oxygen conditions, after 1 hour. In one embodiment, the genetically engineered bacteria increase the adenosine degradation by about 55% to 65% relative to unmodified bacteria of the same bacterial subtype under the same conditions, i.e., when induced under low oxygen conditions after 1 hour. In one specific embodiment, the genetically engineered bacteria increase the adenosine degradation by about 55% to 60% relative to unmodified bacteria of the same bacterial subtype under the same conditions, i.e., when induced under low oxygen conditions, after 1 hour. In yet another embodiment, the genetically engineered bacteria increase the adenosine degradation by about 1.5-3 fold when induced under low oxygen conditions, after 1 hour. In one specific embodiment, the genetically engineered bacteria increase the adenosine degradation by about 2-2.5 fold when induced under low oxygen conditions, after 1 hour.

In one embodiment, the genetically engineered bacteria increase the adenosine degradation by about 85% to 100% relative to unmodified bacteria of the same bacterial subtype under the same conditions, i.e., when induced under low oxygen conditions, after 2 hours. In one embodiment, the genetically engineered bacteria increase the adenosine degradation by about 95% to 100% relative to unmodified bacteria of the same bacterial subtype under the same conditions, i.e., when induced under low oxygen conditions after 2 hours. In one specific embodiment, the genetically engineered bacteria increase the adenosine degradation by about 97% to 99% relative to unmodified bacteria of the same bacterial subtype under the same conditions, i.e., when induced under low oxygen conditions, after 2 hours.

In yet another embodiment, the genetically engineered bacteria increase the adenosine degradation by about 40-50 fold when induced under low oxygen conditions, after 2 hours. In one specific embodiment, the genetically engineered bacteria increase the adenosine degradation by about 44-48 fold when induced under low oxygen conditions, after 2 hours.

In one embodiment, the genetically engineered bacteria increase the adenosine degradation by about 95% to 100% relative to unmodified bacteria of the same bacterial subtype under the same conditions, i.e., when induced under low oxygen conditions, after 3 hours. In one embodiment, the genetically engineered bacteria increase the adenosine degradation by about 98% to 100% relative to unmodified bacteria of the same bacterial subtype under the same conditions, i.e., when induced under low oxygen conditions after 3 hours. In one specific embodiment, the genetically engineered bacteria increase the adenosine degradation by about 99% to 99% relative to unmodified bacteria of the same bacterial subtype under the same conditions, i.e., when induced under low oxygen conditions, after 3 hours. In yet another embodiment, the genetically engineered bacteria increase the adenosine degradation by about 100-1000 fold when induced under low oxygen conditions, after 3 hours. In yet another embodiment, the genetically engineered bacteria increase the adenosine degradation by about 1000-10000 fold when induced under low oxygen conditions, after 3 hours.

In one embodiment, the genetically engineered bacteria increase the adenosine degradation by about 95% to 100% relative to unmodified bacteria of the same bacterial subtype under the same conditions, i.e., when induced under low oxygen conditions, after 4 hours. In one embodiment, the genetically engineered bacteria increase the adenosine degradation by about 98% to 100% relative to unmodified bacteria of the same bacterial subtype under the same conditions, i.e., when induced under low oxygen conditions after 4 hours. In one embodiment, the genetically engineered bacteria increase the adenosine degradation by about 99% to 99% relative to unmodified bacteria of the same bacterial subtype under the same conditions, i.e., when induced under low oxygen conditions, after 4 hours. In yet another embodiment, the genetically engineered bacteria increase the adenosine degradation by about 100-1000 fold when induced under low oxygen conditions, after 4 hours. In yet another embodiment, the genetically engineered bacteria increase the adenosine degradation by about 1000-10000 fold when induced under low oxygen conditions, after 4 hours.

In any of these embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered microorganisms are capable of expressing any one or more of the described circuits for the degradation of adenosine in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding circuitry for the degradation of adenosine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described adenosine degradation circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In some embodiments, the genetically engineered bacteria comprise a means for increasing the level of ATP in the tumor microenvironment, e.g., by increasing the production and secretion of ATP from the microorganism. In some embodiments, the genetically engineered bacteria comprise one or more means for reducing the levels of adenosine in the tumor microenvironment (e.g., by increasing the uptake of adenosine, by metabolizing and/or degrading adenosine), increasing the levels of ATP in the tumor microenvironment, and/or preventing or blocking the conversion of ATP to adenosine in the tumor microenvironment. In any of these embodiments, the genetically engineered bacterium is a tumor-targeting bacterium. In some embodiments, the genetically engineered bacterium comprises one or more genes for metabolizing adenosine, under the control of a promoter that is activated by low-oxygen conditions, by hypoxic conditions, or by inflammatory conditions, such as any of the promoters activated by said conditions and described herein. In some embodiments, the genetically engineered bacteria expresses one or more genes for metabolizing adenosine under the control of a cancer-specific promoter, a tissue-specific promoter, or a constitutive promoter, such as any of the promoters described herein.

Arginine/Arginase I Metabolism

L-Arginine (L-Arg) is a nonessential amino acid that plays a central role in several biological systems including the immune response. The importance of L-Arg on the immune response was initially suggested by the association between impaired T-cell function and a reduction in serum L-Arg levels found in patients and rodents after liver transplantation or trauma, a process that was rapidly reversed by the supplementation of L-Arg. T cells cultured in the absence of L-Arg lose CD3 expression and are unable to proliferate. Notably, T cells that infiltrate tumors also have been observed to have a decreased expression of signal transduction proteins, a diminished ability to proliferate, and a decreased production of cytokines.

L-Arginine is metabolized by arginase I, arginase II, and the inducible nitric oxide synthase. Arginase 1 hydrolyzes L-Arginine into urea and L-ornithine, the latter being the main substrate for the production of polyamines (putrescine, spermidine, and spermine) that are required for cell cycle progression. High arginase activity has been observed in patients with various malignancies including gastric, colon, breast, and lung cancers and has also been associated with the need for malignant cells to produce polyamines to sustain their rapid proliferation.

Recent studies have revealed a distinct subpopulation of tumor-infiltrating myeloid cells, and not tumor cells, that produce high levels of arginase I and cationic amino acid transporter 2B, which allow them to rapidly incorporate L-Arginine (L-Arg) and deplete extracellular L-Arg the tumor microenvironment. These cells are potent inhibitors of T-cell receptor expression and antigen-specific T-cell responses. These cells have also been shown to be potent inducers of regulatory T cells. Other cells within the tumor microenvironment including the malignant cells, T lymphocytes, and even other myeloid subpopulations did not produce arginase I and did not impair T-cell function. Therefore, it is thought that these tumor-infiltrating myeloid cells represent a unique subpopulation with the ability to suppress the protective immune response through various mechanisms. In addition, the almost complete inhibition of the suppressive function of these tumor-associated myeloid cells by an Arginase inhibitor suggested that arginase I may represent one of the principal mechanisms used by these cells to impair T-cell function. Therefore, the increase in arginase I expression may not only facilitate tumor growth, but may also have as a secondary effect, the local reduction of L-Arg levels allowing tumors to escape the immune response.

In addition, MDSC inhibit effectively antitumoral adaptive immune responses mainly by the production of reactive oxygen intermediates and by the expression of the arginine-metabolizing enzymes nitric oxide synthase and arginase. Two mammalian arginase isoforms exist, which both hydrolyze arginine to ornithine and urea. MDSC can suppress T cell immune functions by constitutive expression of arginase with consecutive L-arginine depletion. Arginase I-mediated arginine depletion in the tumor microenvironment leads to inhibition of T lymphocyte proliferation, cytokine synthesis and anti-tumor immune responses. In human T lymphocytes, the absence of arginine induces a downregulation of the signal transducing T cell receptor-associated chain, impairs dephosphorylation of the actin-binding protein cofilin and inhibits progression through the cell cycle via induction of a G0-G1 arrest. In addition, MDSC-derived iNOS converts L-arginine to citrulline and NO, which suppresses T cell function through inhibition of Jak/STAT signaling, reducing MHC class II expression and inducing T cell apoptosis (Munder, Br J Pharmacol. 2009 October; 158(3): 638-651. Arginase: an emerging key player in the mammalian immune system). Thus, the development of arginase inhibitors for clinical use is of prime importance in light of all the accumulated data on the role of arginase in tumor-associated MDSC and its pathogenetic role in inflammation-induced immunosuppression.

Thus, in certain embodiments, the engineered microorganisms of the present disclosure, e.g., engineered bacteria are able to deplete or decrease the levels of arginase I found in the tumor microenvironment. As discussed, L-Arginine is metabolized by arginase I, which hydrolyzes L-Arginine into urea and L-ornithine. Thus, the level of arginase I can be depleted by the addition of L-Arginine to the tumor microenvironment. Moreover, several studies have shown that L-Arginine serves as an effective inhibitor of arginase I. (Rodriguez et al., Arginase I Production in the Tumor Microenvironment by Mature Myeloid Cells Inhibits T-Cell Receptor Expression and Antigen-Specific T-Cell Responses, 2004, Can Res, 64:5839). Thus, in certain embodiments, the engineered microorganisms of the present disclosure, are able to produce L-Arginine. Microorganisms, genetic circuits for engineering, and methods for engineering microorganisms to produce arginine are provided in U.S. Ser. No. 14/960,333 and PCT/US2015/064140, the contents of which are hereby incorporated by references in their entireties, including the drawings.

In some embodiments, the genetically engineered bacteria that produce L-Arginine comprise one or more gene sequences encoding one or more enzymes of the L-Arginine biosynthetic pathway. In some embodiments, the genetically engineered bacteria comprise one or more gene sequences encoding one or more enzymes that are capable of converting glutamate to arginine. In some embodiments, the genetically engineered bacteria comprise an Arginine operon. In some embodiments, the genetically engineered bacteria comprise the Arginine operon of E. coli, as described in detail below. In some embodiments, the genetically engineered bacteria comprise the Arginine operon of another bacteria as described in detail below. In any of these embodiments, the arginine repressor (ArgR) optionally may be deleted, mutated, or modified so as to diminish or obliterate its repressor function.

In bacteria such as Escherichia coli (E. coli), the arginine biosynthesis pathway is capable of converting glutamate to arginine in an eight-step enzymatic process involving the enzymes N-acetylglutamate synthetase, N-acetylglutamate kinase, N-acetylglutamate phosphate reductase, acetylornithine aminotransferase, N-acetylornithinase, carbamoylphosphate synthase, ornithine transcarbamylase, arginosuccinate synthase, and arginosuccinate lyase (Cunin et al., 1986). The first five steps involve N-acetylation to generate an ornithine precursor. In the sixth step, ornithine transcarbamylase (also known as ornithine carbamoyltransferase) catalyzes the formation of citrulline. The final two steps involve carbamoylphosphate utilization to generate arginine from citrulline.

ArgA encodes N-acetylglutamate synthetase, argB encodes N-acetylglutamate kinase, argC encodes N-acetylglutamylphosphate reductase, argD encodes acetylornithine aminotransferase, argE encodes N-acetylornithinase, argF encodes ornithine transcarbamylase, argI also encodes ornithine transcarbamylase, argG encodes arginosuccinate synthase, argH encodes arginosuccinate lyase, and argJ encodes ornithine acetyltransferase. CarA encodes the small A subunit of carbamoylphosphate synthase having glutaminase activity, and carB encodes the large B subunit of carbamoylphosphate synthase that catalyzes carbamoylphosphate synthesis from ammonia. Different combinations of one or more of these arginine biosynthesis genes (i.e., argA, argB, argC, argD, argE, argF, argG, argH, argI, argJ, carA, and carB) may be organized, naturally or synthetically, into one or more operons, and such organization may vary between bacterial species, strains, and subtypes. The regulatory region of each operon contains at least one ARG box, and the number of ARG boxes per regulatory region may vary between operons and bacteria.

All of the genes encoding these enzymes are subject to repression by arginine via its interaction with ArgR to form a complex that binds to the regulatory region of each gene and inhibits transcription. N-acetylglutamate synthetase is also subject to allosteric feedback inhibition at the protein level by arginine alone (Tuchman et al., 1997; Caldara et al., 2006; Caldara et al., 2008; Caldovic et al., 2010).

The genes that regulate arginine biosynthesis in bacteria are scattered across the chromosome and organized into multiple operons that are controlled by a single repressor, which Maas and Clark (1964) termed a "regulon." Each operon is regulated by a regulatory region comprising at least one 18-nucleotide imperfect palindromic sequence, called an ARG box, that overlaps with the promoter and to which the repressor protein binds (Tian et al., 1992; Tian et al., 1994). The argR gene encodes the repressor protein, which binds to one or more ARG boxes (Lim et al., 1987). Arginine functions as a corepressor that activates the arginine repressor. The ARG boxes that regulate each operon may be non-identical, and the consensus ARG box sequence is A/T nTGAAT A/T A/T T/A T/A (SEQ ID NO: 1246) (Maas, 1994). In addition, the regulatory region of argR contains two promoters, one of which overlaps with two ARG boxes and is autoregulated.

In some embodiments, the genetically engineered bacteria comprise a mutant arginine regulon and produce more arginine, than unmodified bacteria or virus of the same subtype under the same conditions. The mutant arginine regulon comprises one or more nucleic acid mutations that reduce or prevent arginine-mediated repression—via ArgR binding to ARG boxes and/or arginine binding to N-acetylglutamate synthetase—of one or more of the operons that encode the enzymes responsible for converting glutamate to arginine in the arginine biosynthesis pathway, thereby enhancing arginine and/or intermediate byproduct biosynthesis.

In some engineered bacteria or engineered virus, the arginine regulon includes, but is not limited to, argA, encoding N-acetylglutamate synthetase; argB, encoding N-acetylglutamate kinase; argC, encoding N-acetylglutamylphosphate reductase; argD, encoding acetylornithine aminotransferase; argE, encoding N-acetylornithinase; argG, encoding argininosuccinate synthase; argH, encoding argininosuccinate lyase; one or both of argF and argI, each of which independently encodes ornithine transcarbamylase; carA, encoding the small subunit of carbamoylphosphate synthase; carB, encoding the large subunit of carbamoylphosphate synthase; operons thereof; operators thereof; promoters thereof; ARG boxes thereof; and/or regulatory regions thereof. In some embodiments, the arginine regulon comprises argJ, encoding ornithine acetyltransferase (either in addition to or in lieu of N-acetylglutamate synthetase and/or N-acetylornithinase), operons thereof, operators thereof, promoters thereof, ARG boxes thereof, and/or regulatory regions thereof.

In some embodiments, the genetically engineered bacteria or genetically engineered viruses comprise an arginine biosynthesis pathway and are capable of producing arginine. In a more specific aspect, the genetically engineered bacteria or genetically engineered viruses comprise a mutant arginine regulon in which one or more operons encoding arginine biosynthesis enzyme(s) is derepressed to produce more arginine than unmodified bacteria of the same subtype under the same conditions. In some embodiments, the genetically engineered bacteria or genetically engineered viruses overproduce arginine.

One of skill in the art would appreciate that the organization of arginine biosynthesis genes within an operon varies across species, strains, and subtypes of bacteria, e.g., bipolar argECBH in *E. coli* K12, argCAEBD-carAB-argF in *B. subtilis*, and bipolar carAB-argCJBDF in *L. plantarum*. Non-limiting examples of operon organization from different bacteria are shown in the Table 6 below (in some instances, the genes are putative and/or identified by sequence homology to known sequences in *Escherichia coli*; in some instances, not all of the genes in the arginine regulon are known and/or shown below). In certain instances, the arginine biosynthesis enzymes vary across species, strains, and subtypes of bacteria.

TABLE 6

Examples of Arg operon organization

| Bacteria | Operon organization | | | | | | |
|---|---|---|---|---|---|---|---|
| *Escherichia coli* Nissle | argA | bipolar argECBH | argD | argI | argG | carAB | |
| *Bacteroides* | argRGCD | argF | argB | argE | carAB | | |
| *Clostridium* | argR | | argGH | | argI | | |
| *Bacillus subtilis* | argGH | | argCAEBD-carAB-argF | | | | |
| *Bacillus subtilis* | argGH | | argCJBD-carAB-argF | | | | |
| *Lactobacillus plantarum* | argGH | | bipolar carAB-argCJBDF | | | | |
| *Lactococcus* | argE | carA | carB | argGH | argFBDJC | | |

Each operon is regulated by a regulatory region comprising at least one promoter and at least one ARG box, which control repression and expression of the arginine biosynthesis genes in said operon.

In some embodiments, the genetically engineered bacteria or genetically engineered viruses comprise an arginine regulon comprising one or more nucleic acid mutations that reduce or eliminate arginine-mediated repression of one or more of the operons that encode the enzymes responsible for converting glutamate to arginine in the arginine biosynthesis pathway. Reducing or eliminating arginine-mediated repression may be achieved by reducing or eliminating ArgR repressor binding (e.g., by mutating or deleting the arginine repressor or by mutating at least one ARG box for each of the operons that encode the arginine biosynthesis enzymes) and/or arginine binding to N-acetylglutamate synthetase (e.g., by mutating the N-acetylglutamate synthetase to produce an arginine feedback resistant N-acetylglutamate synthase mutant, e.g., argAfbr).

ARG Box

In some embodiments, the genetically engineered bacteria or genetically engineered viruses comprise a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, thereby derepressing the regulon and enhancing arginine and/or intermediate byproduct biosynthesis. In some embodiments, the genetically engineered bacteria comprise a mutant arginine repressor comprising one or more nucleic acid mutations such that arginine repressor function is decreased or inactive, or the genetically engineered bacteria do not have an arginine repressor (e.g., the arginine repressor gene has been deleted), resulting in derepression of the regulon and enhancement of arginine and/or intermediate byproduct biosynthesis. In either of these embodiments, the genetically engineered bacteria or genetically engineered viruses may further comprise an arginine feedback resistant N-acetylglutamate synthase mutant, e.g., argAfbr. Thus, in some embodiments, the genetically engineered bacteria or genetically engineered viruses comprise a mutant arginine regulon comprising one or more nucleic acid mutations in at least one ARG box for one or more of the operons that encode the arginine biosynthesis enzymes and an arginine feedback resistant N-acetylglutamate synthase mutant, e.g., argA$^{fbr}$. In some embodiments, the genetically engineered bacteria or genetically engineered viruses comprise a mutant or deleted arginine repressor and an arginine feedback resistant N-acetylglutamate synthase mutant, e.g., argA$^{fbr}$. In some embodiments, the genetically engineered bacteria comprise an arginine feedback resistant N-acetylglutamate synthase mutant, e.g., argA$^{fbr}$, a mutant arginine regulon comprising one or more nucleic acid mutations in at least one ARG box for each of the operons that encode the arginine biosynthesis enzymes, and/or a mutant or deleted arginine repressor.

In some embodiments, the genetically engineered bacteria or genetically engineered viruses encode an arginine feedback resistant N-acetylglutamate synthase and further comprise a mutant arginine regulon comprising one or more nucleic acid mutations in each ARG box for one or more of the operons that encode N-acetylglutamate kinase, N-acetylglutamylphosphate reductase, acetylornithine aminotransferase, N-acetylornithinase, ornithine transcarbamylase, argininosuccinate synthase, argininosuccinate lyase, carbamoylphosphate synthase, and wild-type N-acetylglutamate synthetase, such that ArgR binding is reduced or eliminated, thereby derepressing the regulon and enhancing arginine and/or intermediate byproduct biosynthesis. For example, the regulatory region of the operon encoding argininosuccinate synthase (argG) may be a constitutive, thereby driving arginine biosynthesis.

In some embodiments, all ARG boxes in one or more operons that comprise an arginine biosynthesis gene are mutated to reduce or eliminate ArgR binding. In some embodiments, all ARG boxes in one or more operons that encode an arginine biosynthesis enzyme are mutated to reduce or eliminate ArgR binding. In some embodiments, all ARG boxes in each operon that comprises an arginine biosynthesis gene are mutated to reduce or eliminate ArgR binding. In some embodiments, all ARG boxes in each operon that encodes an arginine biosynthesis enzyme are mutated to reduce or eliminate ArgR binding.

In some embodiments, the genetically engineered bacteria or genetically engineered viruses encode an arginine feedback resistant N-acetylglutamate synthase, argininosuccinate synthase driven by a constitutive promoter, and further comprise a mutant arginine regulon comprising one or more nucleic acid mutations in each ARG box for each of the operons that encode N-acetylglutamate kinase, N-acetylglutamylphosphate reductase, acetylornithine aminotransferase, N-acetylornithinase, ornithine transcarbamylase, argininosuccinate lyase, carbamoylphosphate synthase, and optionally, wild-type N-acetylglutamate synthetase, such that ArgR binding is reduced or eliminated, thereby derepressing the regulon and enhancing arginine biosynthesis.

In some embodiments, the genetically engineered bacteria or genetically engineered viruses comprise a mutant arginine regulon and a feedback resistant ArgA, and when the arginine feedback resistant ArgA is expressed, are capable of producing more arginine than unmodified bacteria of the same subtype under the same conditions.

In some embodiments, the ARG box is at least about 80%, at least about 85%, at least about 90%, at least about 95%, or at least about 99% homologous to the sequence of SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, and/or SEQ ID NO: 99.

In some embodiments, more than one ARG box may be present in a single operon. In one aspect of these embodiments, at least one of the ARG boxes in an operon is mutated to produce the requisite reduced ArgR binding to the regulatory region of the operon. In an alternate aspect of these embodiments, each of the ARG boxes in an operon is mutated to produce the requisite reduced ArgR binding to the regulatory region of the operon. For example, the carAB operon in *E. coli* Nissle comprises two ARG boxes, and one or both ARG box sequences may be mutated. The argG operon in *E. coli* Nissle comprises three ARG boxes, and one, two, or three ARG box sequences may be mutated, disrupted, or deleted. In some embodiments, all three ARG box sequences are mutated, disrupted, or deleted, and a constitutive promoter, e.g., BBa_J23100, is inserted in the regulatory region of the argG operon. One of skill in the art would appreciate that the number of ARG boxes per regulatory region may vary across bacteria, and the nucleotide sequences of the ARG boxes may vary for each operon.

"Arginine operon," "arginine biosynthesis operon," and "arg operon" are used interchangeably to refer to a cluster of one or more of the genes encoding arginine biosynthesis enzymes under the control of a shared regulatory region comprising at least one promoter and at least one ARG box. In some embodiments, the one or more genes are co-transcribed and/or co-translated. Any combination of the genes encoding the enzymes responsible for arginine biosynthesis may be organized, naturally or synthetically, into an operon. For example, in *B. subtilis*, the genes encoding N-acetylglutamylphosphate reductase, N-acetylglutamate kinase, N-acetylornithinase, N-acetylglutamate kinase, acetylornithine aminotransferase, carbamoylphosphate synthase, and ornithine transcarbamylase are organized in a single operon, argCAEBD-carAB-argF, under the control of a shared regulatory region comprising a promoter and ARG boxes. In *E. coli* K12 and Nissle, the genes encoding N-acetylornithinase, N-acetylglutamylphosphate reductase, N-acetylglutamate kinase, and argininosuccinate lyase are organized in two bipolar operons, argECBH. The operons encoding the enzymes responsible for arginine biosynthesis may be distributed at different loci across the chromosome. In unmodified bacteria, each operon may be repressed by arginine via ArgR. In some embodiments, arginine and/or intermediate byproduct production may be altered in the genetically engineered bacteria or genetically engineered viruses by modifying the expression of the enzymes encoded by the arginine biosynthesis operons as provided herein. Each arginine operon may be present on a plasmid or bacterial chromosome. In addition, multiple copies of any arginine operon, or a gene or regulatory region within an arginine operon, may be present in the bacterium or virus, wherein one or more copies of the operon or gene or regulatory region may be mutated or otherwise altered as described herein. In some embodiments, the genetically engineered bacteria or genetically engineered viruses are engineered to comprise multiple copies of the same product (e.g., operon or gene or regulatory region) to enhance copy number or to comprise multiple different components of an operon performing multiple different functions.

"ARG box consensus sequence" refers to an ARG box nucleic acid sequence, the nucleic acids of which are known to occur with high frequency in one or more of the regulatory regions of argR, argA, argB, argC, argD, argE, argF, argG, argH, argI, argJ, carA, and/or carB. As described above, each arg operon comprises a regulatory region comprising at least one 18-nucleotide imperfect palindromic sequence, called an ARG box, that overlaps with the promoter and to which the repressor protein binds (Tian et al., 1992). The nucleotide sequences of the ARG boxes may vary for each operon, and the consensus ARG box sequence is A/T nTGAAT A/T A/T T/A T/A ATTCAn T/A (SEQ ID NO: 1246) (Maas, 1994). The arginine repressor binds to one or more ARG boxes to actively inhibit the transcription of the arginine biosynthesis enzyme(s) that are operably linked to that one or more ARG boxes.

"Mutant arginine regulon" or "mutated arginine regulon" is used to refer to an arginine regulon comprising one or more nucleic acid mutations that reduce or eliminate arginine-mediated repression of each of the operons that encode the enzymes responsible for converting glutamate to arginine in the arginine biosynthesis pathway, such that the mutant arginine regulon produces more arginine and/or intermediate byproduct than an unmodified regulon from the same bacterial subtype under the same conditions. In some embodiments, the genetically engineered bacteria or genetically engineered viruses comprise an arginine feedback resistant N-acetylglutamate synthase mutant, e.g., argA$^{fbr}$, and a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, thereby derepressing the regulon and enhancing arginine and/or intermediate byproduct biosynthesis. In some embodiments, the genetically engineered bacteria or genetically engineered viruses comprise a mutant arginine repressor comprising one or more nucleic acid mutations such that arginine repressor function is decreased or inactive, or the genetically engineered bacteria or genetically engineered viruses do not have an arginine repressor (e.g., the arginine repressor gene has been deleted), resulting in derepression of the regulon and enhancement of arginine and/or intermediate byproduct biosynthesis. In some embodiments, the genetically engineered bacteria or genetically engineered viruses comprise an arginine feedback resistant N-acetylglutamate synthase mutant, e.g., argA$^{fbr}$, a mutant arginine regulon comprising one or more nucleic acid mutations in at least one ARG box for each of the operons that encode the arginine biosynthesis enzymes, and/or a mutant or deleted arginine repressor. In some embodiments, the genetically engineered bacteria or genetically engineered viruses comprise an arginine feedback resistant N-acetylglutamate synthase mutant, e.g., argA$^{fbr}$ and a mutant arginine regulon comprising one or more nucleic acid mutations in at least one ARG box for each of the operons that encode the arginine biosynthesis enzymes. In some embodiments, the genetically engineered bacteria or genetically engineered viruses comprise an arginine feedback resistant N-acetylglutamate synthase mutant, e.g., argA$^{fbr}$ and a mutant or deleted arginine repressor. In some embodiments, the mutant arginine regulon comprises an operon encoding wild-type N-acetylglutamate synthetase and one or more nucleic acid mutations in at least one ARG box for said operon. In some embodiments, the mutant arginine regulon comprises an operon encoding wild-type N-acetylglutamate synthetase and mutant or deleted arginine repressor. In some embodiments, the mutant arginine regulon comprises an operon encoding ornithine acetyltransferase (either in addition to or in lieu of N-acetylglutamate synthetase and/or N-acetylornithinase) and one or more nucleic acid mutations in at least one ARG box for said operon.

The ARG boxes overlap with the promoter in the regulatory region of each arginine biosynthesis operon. In the mutant arginine regulon, the regulatory region of one or more arginine biosynthesis operons is sufficiently mutated to disrupt the palindromic ARG box sequence and reduce ArgR binding, but still comprises sufficiently high homology to the promoter of the non-mutant regulatory region to be recognized as the native operon-specific promoter. The operon comprises at least one nucleic acid mutation in at least one ARG box such that ArgR binding to the ARG box and to the regulatory region of the operon is reduced or eliminated. In some embodiments, bases that are protected from DNA methylation and bases that are protected from hydroxyl radical attack during ArgR binding are the primary targets for mutations to disrupt ArgR binding. The promoter of the mutated regulatory region retains sufficiently high homology to the promoter of the non-mutant regulatory region such that RNA polymerase binds to it with sufficient affinity to promote transcription of the operably linked arginine biosynthesis enzyme(s). In some embodiments, the G/C:A/T ratio of the promoter of the mutant differs by no more than 10% from the G/C:A/T ratio of the wild-type promoter.

In some embodiments, more than one ARG box may be present in a single operon. In one aspect of these embodiments, at least one of the ARG boxes in an operon is altered to produce the requisite reduced ArgR binding to the regulatory region of the operon. In an alternate aspect of these embodiments, each of the ARG boxes in an operon is altered to produce the requisite reduced ArgR binding to the regulatory region of the operon.

"Reduced" ArgR binding is used to refer to a reduction in repressor binding to an ARG box in an operon or a reduction in the total repressor binding to the regulatory region of said operon, as compared to repressor binding to an unmodified ARG box and regulatory region in bacteria of the same subtype under the same conditions.

"ArgR" or "arginine repressor" is used to refer to a protein that is capable of suppressing arginine biosynthesis by regulating the transcription of arginine biosynthesis genes in the arginine regulon. When expression of the gene that encodes for the arginine repressor protein ("argR") is increased in a wild-type bacterium, arginine biosynthesis is decreased. When expression of argR is decreased in a wild-type bacterium or virus, or if argR is deleted or mutated to inactivate arginine repressor function, arginine biosynthesis is increased.

Bacteria that "lack any functional ArgR" and "ArgR deletion bacteria" are used to refer to bacteria in which each arginine repressor has significantly reduced or eliminated activity as compared to unmodified arginine repressor from bacteria of the same subtype under the same conditions. Reduced or eliminated arginine repressor activity can result in, for example, increased transcription of the arginine biosynthesis genes and/or increased concentrations of arginine. Bacteria in which arginine repressor activity is reduced or eliminated can be generated by modifying the bacterial argR gene or by modifying the transcription of the argR gene. For example, the chromosomal argR gene can be deleted, can be mutated, or the argR gene can be replaced with an argR gene that does not exhibit wild-type repressor activity.

In some embodiments, the genetically engineered bacteria or genetically engineered viruses comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase additionally comprise an arginine feedback resistant N-acetylglutamate synthase mutant, e.g., argAfbr.

In some embodiments, the genetically engineered bacteria or genetically engineered viruses comprise a feedback resistant form of ArgA, as well as one or more nucleic acid mutations in each ARG box of one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, ornithine acetyltransferase, and carbamoylphosphate synthase.

In some embodiments, the genetically engineered bacteria or genetically engineered viruses comprise a feedback resistant form of ArgA, argininosuccinate synthase expressed from a constitutive promoter, as well as one or more nucleic acid mutations in each ARG box of each of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, ornithine acetyltransferase, and carbamoylphosphate synthase. In these embodiments, the bacteria are capable of producing arginine.

The Table below shows examples of mutant constructs in which one or more nucleic acid mutations reduce or eliminate arginine-mediated repression of each of the arginine operons. The mutant constructs comprise feedback resistant form of ArgA driven by an oxygen level-dependent promoter, e.g., a FNR promoter. Each mutant arginine regulon comprises one or more nucleic acid mutations in at least one ARG box for one or more of the operons that encode N-acetylglutamate kinase, N-acetylglutamylphosphate reductase, acetylornithine aminotransferase, N-acetylornithinase, ornithine transcarbamylase, argininosuccinate synthase, argininosuccinate lyase, carbamoylphosphate synthase, and wild-type N-acetylglutamate synthetase, such that ArgR binding is reduced or eliminated, thereby enhancing arginine and/or intermediate byproduct biosynthesis. Non-limiting examples of mutant arginine regulon constructs are for example described in PCT/US2016/034200, filed May 25, 2016 and Ser. No. 15/164,828 filed May 25, 2016, published as US20160333326, and PCT/US2015/064140, filed Dec. 4, 2015, and U.S. Pat. No. 9,487,764, filed Dec. 4, 2015, the contents of each of which is herein incorporated by reference it its entirety.

The mutations may be present on a plasmid or chromosome. In some embodiments, the arginine regulon is regulated by a single repressor protein. In particular species, strains, and/or subtypes of bacteria, it has been proposed that the arginine regulon may be regulated by two putative repressors (Nicoloff et al., 2004). Thus, in certain embodiments, the arginine regulon of the invention is regulated by more than one repressor protein.

In certain embodiments, the mutant arginine regulon is expressed in one species, strain, or subtype of genetically engineered bacteria. In alternate embodiments, the mutant arginine regulon is expressed in two or more species, strains, and/or subtypes of genetically engineered bacteria.

Arginine Repressor Binding Sites (ARG Boxes)

In some embodiments, the genetically engineered bacteria additionally comprise a mutant arginine regulon comprising one or more nucleic acid mutations in at least one ARG box for one or more of the operons that encode the arginine biosynthesis enzymes N-acetylglutamate kinase, N-acetylglutamylphosphate reductase, acetylornithine aminotransferase, N-acetylornithinase, ornithine transcarbamylase, argininosuccinate synthase, argininosuccinate lyase, and carbamoylphosphate synthase, such that the arginine regulon is derepressed and biosynthesis of arginine and/or an intermediate byproduct, e.g., citrulline, is enhanced. Such genetically engineered bacteria are described in International Patent Application PCT/US2017/013072, filed Jan. 11, 2016, published as WO2017/123675, the contents of which is herein incorporated by reference in its entirety.

Arginine Repressor (ArgR)

The genetically engineered bacteria or genetically engineered viruses comprise an arginine regulon comprising one or more nucleic acid mutations that reduce or eliminate arginine-mediated repression of one or more of the operons that encode the enzymes responsible for converting glutamate to arginine and/or an intermediate byproduct in the arginine biosynthesis pathway. In some embodiments, the reduction or elimination of arginine-mediated repression may be achieved by reducing or eliminating ArgR repressor binding, e.g., by mutating at least one ARG box for one or more of the operons that encode the arginine biosynthesis enzymes (as discussed above) or by mutating or deleting the arginine repressor (discussed here) and/or by reducing or eliminating arginine binding to N-acetylglutamate synthetase (e.g., by mutating the N-acetylglutamate synthetase to produce an arginine feedback resistant N-acetylglutamate synthase mutant, e.g., $\text{argA}^{fbr}$).

Thus, in some embodiments, the genetically engineered bacterial or genetically engineered viruses ack a functional ArgR repressor and therefore ArgR repressor-mediated transcriptional repression of each of the arginine biosynthesis operons is reduced or eliminated. In some embodiments, the engineered bacteria comprise a mutant arginine repressor comprising one or more nucleic acid mutations such that arginine repressor function is decreased or inactive. In some embodiments, the genetically engineered bacteria or genetically engineered viruses do not have an arginine repressor (e.g., the arginine repressor gene has been deleted), resulting in derepression of the regulon and enhancement of arginine and/or intermediate byproduct biosynthesis. In some embodiments, each copy of a functional argR gene normally present in a corresponding wild-type bacterium is independently deleted or rendered inactive by one or more nucleotide deletions, insertions, or substitutions. In some embodiments, each copy of the functional argR gene normally present in a corresponding wild-type bacterium is deleted.

In some embodiments, the arginine regulon is regulated by a single repressor protein. In particular species, strains, and/or subtypes of bacteria, it has been proposed that the arginine regulon may be regulated by two distinct putative repressors (Nicoloff et al., 2004). Thus, in certain embodiments, two distinct ArgR proteins each comprising a different amino acid sequence are mutated or deleted in the genetically engineered bacteria or genetically engineered viruses.

In some embodiments, the genetically modified bacteria or genetically engineered viruses comprising a mutant or deleted arginine repressor additionally comprise an arginine feedback resistant N-acetylglutamate synthase mutant, e.g., $\text{argA}^{fbr}$. In some embodiments, the genetically engineered bacteria or genetically engineered viruses comprise a feedback resistant form of ArgA, lack any functional arginine repressor, and are capable of producing arginine. In some embodiments, the argR gene is deleted in the genetically engineered bacteria or genetically engineered viruses. In some embodiments, the argR gene is mutated to inactivate ArgR function. In some embodiments, the argG gene is deleted in the genetically engineered bacteria or genetically engineered viruses. In some embodiments, the argG gene is mutated to inactivate ArgR function. In some embodiments, the genetically engineered bacteria or genetically engineered viruses comprise argA and deleted ArgR. In some embodiments, the genetically engineered bacteria or genetically engineered viruses comprise $argA^{fbr}$, deleted ArgR, and deleted argG. In some embodiments, the deleted ArgR and/or the deleted argG is deleted from the bacterial genome and the $argA^{fbr}$ is present in a plasmid. In some embodiments, the deleted ArgR and/or the deleted argG is deleted from the bacterial genome and the $argA^{fbr}$ is chromosomally integrated. In one specific embodiment, the genetically modified bacteria or genetically engineered viruses comprise chromosomally integrated $argA^{fbr}$, deleted genomic ArgR, and deleted genomic argG. In another specific embodiment, the genetically modified bacteria comprise $argA^{fbr}$ present on a plasmid, deleted genomic ArgR, and deleted genomic argG.

Feedback Resistant N-Acetylglutamate Synthetase

In some embodiments, the genetically engineered bacteria or genetically engineered viruses comprise an arginine feedback resistant N-acetylglutamate synthase mutant, e.g., $argA^{fbr}$. In some embodiments, the genetically engineered bacteria or genetically engineered viruses comprise a mutant arginine regulon comprising an arginine feedback resistant ArgA, and when the arginine feedback resistant ArgA is expressed, are capable of producing more arginine and/or an intermediate byproduct than unmodified bacteria of the same subtype under the same conditions. The arginine feedback resistant N-acetylglutamate synthetase protein ($argA^{fbr}$) is significantly less sensitive to L-arginine than the enzyme from the feedback sensitive parent strain (see, e.g., Eckhardt et al., 1975; Rajagopal et al., 1998). The feedback resistant argA gene can be present on a plasmid or chromosome. In some embodiments, expression from the plasmid may be useful for increasing $argA^{fbr}$ expression. In some embodiments, expression from the chromosome may be useful for increasing stability of $argA^{fbr}$ expression.

In some embodiments, any of the genetically engineered bacteria or genetically engineered viruses of the present disclosure are integrated into the bacterial chromosome at one or more integration sites. For example, one or more copies of the sequence encoding the arginine feedback resistant N-acetylglutamate synthase may be integrated into the bacterial chromosome. Having multiple copies of the arginine feedback resistant N-acetylglutamate synthase integrated into the chromosome allows for greater production of the N-acetylglutamate synthase and also permits fine-tuning of the level of expression. Alternatively, different circuits described herein, such as any of the kill-switch circuits, in addition to the arginine feedback resistant N-acetylglutamate synthase could be integrated into the bacterial chromosome at one or more different integration sites to perform multiple different functions.

Multiple distinct feedback resistant N-acetylglutamate synthetase proteins are known in the art and may be combined in the genetically engineered bacteria or genetically engineered viruses. In some embodiments, the $argA^{fbr}$ gene is expressed under the control of a constitutive promoter. In some embodiments, the $argA^{fbr}$ gene is expressed under the control of a promoter that is induced by tumor microenvironment.

In some embodiments, the plasmid or chromosome also comprises wild-type ArgR binding sites, e.g., ARG boxes. In some instances, the presence and/or build-up of functional ArgR may result in off-target binding at sites other than the ARG boxes, which may cause off-target changes in gene expression. A plasmid or chromosome that further comprises functional ARG boxes may be used to reduce or eliminate off-target ArgR binding, i.e., by acting as an ArgR sink. In some embodiments, the plasmid or chromosome does not comprise functional ArgR binding sites, e.g., the plasmid or chromosome comprises modified ARG boxes or does not comprise ARG boxes.

In some embodiments, the genetically engineered bacteria or genetically engineered viruses comprise argA expressed under the control of an oxygen level-dependent promoter, e.g., a FNR promoter, as well as wild-type argA expressed under the control of a mutant regulatory region comprising one or more ARG box mutations as discussed above. In certain embodiments, the genetically engineered bacteria or genetically engineered viruses comprise $argA^{fbr}$ expressed under the control of an oxygen level-dependent promoter, e.g., a FNR promoter and do not comprise wild-type argA. In still other embodiments, the mutant arginine regulon comprises $argA^{fbr}$ expressed under the control of an oxygen level-dependent promoter, e.g., a FNR promoter, and further comprises wild-type argA without any ARG box mutations.

In some embodiments, the genetically engineered bacteria or genetically engineered viruses express $ArgA^{fbr}$ from a plasmid and/or chromosome. In some embodiments, the $argA^{fbr}$ gene is expressed under the control of a constitutive promoter. In some embodiments, the $argA^{fbr}$ gene is expressed under the control of an inducible promoter. In one embodiment, $argA^{fbr}$ is expressed under the control of an oxygen level-dependent promoter that is activated under low-oxygen or anaerobic environments, e.g., a FNR promoter.

The nucleic acid sequence of an exemplary $argA^{fbr}$ sequence is shown in SEQ ID NO: 102. The polypeptide sequence of an exemplary $argA^{fbr}$ sequence is shown in SEQ ID NO: 103.

In some embodiments, the genetically engineered bacteria comprise the nucleic acid sequence of SEQ ID NO: 102 or a functional fragment thereof. In some embodiments, the genetically engineered bacteria comprise a nucleic acid sequence that, but for the redundancy of the genetic code, encodes the same polypeptide as SEQ ID NO: 102 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 102 or a functional fragment thereof, or a nucleic acid sequence that, but for the redundancy of the genetic code, encodes the same polypeptide as SEQ ID NO: 102 or a functional fragment thereof.

In some embodiments, the genetically engineered bacteria encode a polypeptide sequence of SEQ ID NO: 103 or a functional fragment thereof. In some embodiments, the genetically engineered bacteria encode a polypeptide sequence encodes a polypeptide, which contains one or more conservative amino acid substitutions relative to SEQ ID NO: 103 or a functional fragment thereof. In some embodiments, genetically engineered bacteria encode a polypeptide sequence that is at least about 80%, at least about 85%, at least about 90%, at least about 95%, or at least about 99% homologous to the DNA sequence of SEQ ID NO: 103 or a functional fragment thereof.

In some embodiments, arginine feedback inhibition of N-acetylglutamate synthetase is reduced by at least about 50%, at least about 60%, at least about 70%, at least about 80%, at least about 90%, or at least about 95% in the genetically engineered bacteria when the arginine feedback resistant N-acetylglutamate synthetase is active, as compared to a wild-type N-acetylglutamate synthetase from bacteria of the same subtype under the same conditions.

In any of these embodiments, the bacteria genetically engineered to produce arginine produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more arginine than unmodified bacteria of the same bacterial subtype under the same conditions.

In any of these embodiments, the bacteria genetically engineered to produce arginine consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more glutamate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more glutamate than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

Arginine producing strains are also described in PCT/US2016/034200, filed May 25, 2016 and Ser. No. 15/164,828 filed May 25, 2016, published as US20160333326, and PCT/US2015/064140, filed Dec. 4, 2015, and U.S. Pat. No. 9,487,764, filed Dec. 4, 2015, the contents of each of which is herein incorporated by reference it its entirety.

In some embodiments, the genetically engineered microorganisms for the production of arginine are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) for the production of arginine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits for the production of arginine are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In a non-limiting example, the arginine production circuit may be combined with an anit-CD47 secretion circuit.

Inhibition or Depletion of PGE2

Prostaglandin E2 (PGE2) is overproduced in many tumors, where it aids in cancer progression. PGE2 is a pleiotropic molecule involved in numerous biological processes, including angiogenesis, apoptosis, inflammation, and immune suppression. PGE2 is synthesized from arachidonic acid by cyclooxygenase 2 (COX-2). COX-2, converts arachidonic acid (AA) to prostaglandin endoperoxide H2 (PGH2). PHG2 is then converted to PHE2 by prostaglandin E synthase (PGES), of which there are three forms. PGE2 can be catabolized into biologically inactive 15-keto-PGs by 15-PGDH and carbonyl reductase or secreted by the secreter MRP4.

MDSCs are thought to play a key role in the PGE2 production in the tumor environment. Tumor derived factors induce COX2, PGES1, and MRP4 and downregulate the expression of 15-PGDH in MDSCs, and is associated with MDSC suppressive activity. Inhibition of PGE2 through COX-2 inhibitors show promise as cancer treatments, but systemic administration is associated with serious side effects, and in the case of the COX-2 inhibitor celecoxib, resistance to tumor prevention has been observed.

In addition to inhibition of PGE production, the degradation of PGE2 by 15-hydroxyprostaglandin dehydrogenase (15-PGDH) is another way to reduce PGE2 levels in tumors. A lack of prostaglandin dehydrogenase prevents catabolism of prostaglandin E2, which helps cancer cells both to evade the immune system and circumvent drug treatment. Recent studies have demonstrated that 15-PGDH delivered locally to the tumor microenvironment can effect an antitumor immune response. For example, injection of an adenovirus encoding 15-PGDH into mouse tumors comprising non-lymphocyte white blood cells expressing CD11b (which have increased PGE2 levels, higher COX-2 expression and significantly reduced expression of 15-PGDH as compared with cells from outside the tumor), resulted in significantly slowed tumor growth. These studies further showed that 15-PGDH expression was highest in tumor cells but also significant in tumor-associated CD11b cells, where it produced a four-fold reduction in PGE2 secretion. This was associated with reduced secretion of immunosuppressive cytokines by the CD11b cells which resulted in a switch in their fate, promoting their differentiation into dendritic cells. These studies show that overproduction of PGE2 in tumors contributes to immune evasion by preventing maturation of antigen-presenting cells, and that evasion can be overcome by enforced expression of 15-PGDH. (Eruslanov et al., Volume 88, November 2010 Journal of Leukocyte Biology; Tumor-mediated induction of myeloid-derived suppressor cells and M2-polarized macrophages by altering intracellular PGE2 catabolism in myeloid cells).

Other studies confirm the benefit of local PGE2 catabolism in cancer treatment. Celecoxib, a non-steroidal anti-inflammatory COX-2 inhibitor used to treat pain and inflammation, reduces the recurrence of colon adenomas but does not work in some patients who have low levels of 15-PGDH. These results correspond with studies which show that in mice, gene knockout of 15-PGDH confers near-complete resistance to the ability of celecoxib to prevent colon tumors. These and other studies highlight the potential importance of reducing PGE2 levels in cancer, either through inhibition of synthesis or promotion of catalysis or both.

In some embodiments, the genetically engineered microorganisms, e.g. genetically engineered bacteria produce one or more anti-cancer molecules that are able to decrease or deplete the level of PGE2 in the tumor microenvironment. In certain embodiments, the genetically engineered bacteria produce one or more anti-cancer molecules that are able to inhibit or decrease PGE2 production, e.g., produce a COX-2 inhibitor or an inhibitor of an enzyme in the arachidonic acid synthesis pathway. In certain embodiments, the genetically engineered bacteria produce one or more anti-cancer molecules that promote PGE2 uptake from the tumor microenvironment, e.g., express a PGE2 transporter. In certain embodiments, the genetically engineered bacteria produce one or more anti-cancer molecules that promote, enhance or stimulate PGE2 degradation. In certain embodiments, the genetically engineered bacteria produce one or more anti-cancer molecules that degrade PGE2. In some embodiments, the genetically engineered bacteria produce 15-hydroxyprostaglandin dehydrogenase. In some embodiments, the genetically engineered bacteria produce one or more anti-cancer molecules that are able to inhibit or decrease PGE2 production, and/or promote PGE2 uptake from the tumor microenvironment, e.g., express a PGE2 transporter and/or promote PGE2 degradation, e.g., produce 15-hydroxyprostaglandin dehydrogenase. In any of these embodiments, the genetically engineered bacterium is a tumor-targeting bacterium. In some embodiments, the genetically engineered bacterium comprises sequence for encoding a PGE2 transporter and/or comprise sequence for encoding 15-hydroxyprostaglandin dehydrogenase, under the control of a promoter that is activated by low-oxygen conditions. In some embodiments, the genetically engineered bacterium comprises sequence for encoding a PGE2 transporter and/or comprise sequence for encoding 15-hydroxyprostaglandin dehydrogenase under the control of a promoter that is activated by hypoxic conditions, or by inflammatory conditions, such as any of the promoters activated by said conditions and described herein. In some embodiments, the genetically engineered bacteria comprises sequence for encoding a PGE2 transporter and/or comprise sequence for encoding 15-hydroxyprostaglandin dehydrogenase under the control of a cancer-specific promoter, a tissue-specific promoter, or a constitutive promoter, such as any of the promoters described herein.

Immunosuppressive Cytokines

Certain cytokines, known as immunosuppressive cytokines, are secreted from tumor cells and function to suppress innate and/or adaptive immune responses, in some cases through Tregs, TAMs, and DCregs. Thus, in certain embodiments, the genetically engineered bacteria produce one or more anti-cancer molecules that inhibit one or more immunosuppressive cytokines. Interleukin-10 (IL-10), also known as human cytokine synthesis inhibitory factor (CSIF), is an anti-inflammatory cytokine that is produced by monocytes and lymphocytes (e.g., type 2 T helper cells, mastocytes, $CD4^+CD25^+Foxp3^+$ regulatory T cells (Tregs). IL-10 can be produced by monocytes upon PD-1 triggering in these cells. Il-10 has been shown to downregulate the expression of Th1 cytokines, MHC class II antigens, and co-stimulatory molecules on macrophages. It has also been reported to suppress cytokine secretion, antigen presentation and CD4+ T cell activation. Further investigation has shown that IL-10 inhibits lipopolysaccharide (LPS) and bacterial product mediated induction of the pro-inflammatory cytokines TNFα, IL-1β, IL-12, and IFNγ secretion from Toll-Like Receptor (TLR) triggered myeloid lineage cells.

In certain embodiments, the genetically engineered bacteria produce an anti-cancer molecule that indirectly or directly inhibits IL-10, for example, the genetically engineered microorganism may encode an antibody directed against IL-10, e.g. a single-chain antibody against IL-10. In some embodiments, the genetically engineered bacterium is a tumor-targeting bacterium that expresses an anti-IL-10 antibody, e.g., a single chain antibody. In some embodiments, the genetically engineered bacterium expresses an anti-IL-10 antibody, e.g., single chain antibody, under the control of a promoter that is activated by low-oxygen conditions. In some embodiments, the genetically engineered bacterium is a tumor-targeting bacterium that expresses an anti-IL-10 antibody, e.g., a single chain antibody under the control of a promoter that is activated by low-oxygen conditions. In some embodiments, the genetically engineered bacterium expresses an anti-IL-10 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-IL-10 antibody, e.g., single chain antibody, under the control of a cancer-specific promoter, a tissue-specific promoter, or a constitutive promoter, such as any of the promoters described herein.

CCR4 also has an important role in normal and tumor immunity. C chemokine receptor 4 (CCR4) is important for regulating immune balance and is known to be expressed selectively on Th2 cells and effector Treg cells in both cancer tissues and in peripheral blood. In a subset of patients with CCR4+ T-cell leukemia/lymphoma, the tumor cells themselves function as regulatory T (Treg) cells, contributing to tumor survival in the face of host antitumor immune responses. In other types of cancers, the chemokines TARC/CCL17 and MDC/CCL22, specific ligands for CCR4 that are produced by tumor cells and the tumor microenvironment, attract CCR4+ Treg cells to the tumor, where they create a favorable environment for tumor escape from host immune responses. Studies have shown that tumor-infiltrating macrophages and tumor cells produce the chemokine (C—C motif) ligand 22 (CCL22), which chemoattracts Treg cells as well as effector T cells expressing C—C chemokine receptor type 4 (CCR4). Therefore, inhibition of CCR4 signaling has the potential to promote anti-tumor immune responses by selectively depleting Tregs and preventing them from migrating into the tumor microenvironment. In fact, in vivo and in vitro anti-CCR4 mAb treatment has been shown to selectively deplete effector Treg cells and efficiently induce tumor-antigen-specific CD4$^+$ and CD8$^+$ T cells.

In certain embodiments, the genetically engineered bacteria produce an anti-cancer molecule that inhibits CCR4 and/or inhibits CCL17 and/or inhibits CCL22, for example, the genetically engineered microorganism may encode an antagonistic ligand for CCR4, and/or an antagonistic antibody directed against CCR4 and/or an antibody directed against CCL17 and/or an antibody directed against CCL22, e.g. a single-chain antibody against CCR4 and/or a single chain antibody against CCL17 and/or a single chain antibody against CCL22. In some embodiments, the genetically engineered bacterium is a tumor-targeting bacterium that expresses an antagonistic CCR4 ligand and/or anti-CCR4 antibody and/or anti-CCL17 antibody and/or anti-CCL22 antibody, e.g., a single chain antibody. In some embodiments, the genetically engineered bacterium expresses an antagonistic ligand for CCR4 and/or anti-CCR4 antibody and/or an anti-CCL17 antibody and/or an antiCCL22 antibody, e.g., single chain antibody, under the control of a promoter that is activated by low-oxygen conditions. In some embodiments, the genetically engineered bacterium is a tumor-targeting bacterium that expresses an antagonistic ligand for CCR4 and/or anti-CCR4 antibody and/or an anti-CCL17 antibody and/or an antiCCL22 antibody, e.g., a single chain antibody under the control of a promoter that is activated by low-oxygen conditions. In some embodiments, the genetically engineered bacterium expresses an antagonistic ligand for CCR4 and/or anti-CCR4 antibody and/or an anti-CCL17 antibody and/or an antiCCL22 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an antagonistic ligand for CCR4 and/or anti-CCR4 antibody and/or an anti-CCL17 antibody and/or an antiCCL22 antibody, e.g., single chain antibody, under the control of a cancer-specific promoter, a tissue-specific promoter, or a constitutive promoter, such as any of the promoters described herein.

Interleukin-27 (IL-27) is a member of the IL-12 family of heterodimeric cytokines that signals through receptors that are highly expressed on T cells and/or natural killer cells. IL-27 has been shown to suppress the development and differentiation of Th17 cells in inflammation and to induce a Treg-like activity in Th1 and Th2 effector cells. IL-27 has also been shown to induce IL-10 production and secretion in these Th1 and Th2 cells. These results were confirmed by additional studies which show that IL-27 can induce the production of IL-10 and IFN-gamma, and inhibit IL-17 secretion by anti-CD3, anti-CD28-activated human CD4$^+$ T cells. Also, IL-27-treated T cells suppresses the proliferation of CD4$^+$ T cells in an IL-10-dependent manner. Collectively, these studies indicate that IL-27 plays a role in the production of anti-inflammatory IL-10-producing T cell populations.

In certain embodiments, the genetically engineered bacteria produce an anti-cancer molecule that indirectly or directly inhibits IL-27, for example, the genetically engineered microorganism may encode an antibody directed against IL-27, e.g. a single-chain antibody against IL-27. In some embodiments, the genetically engineered bacterium is a tumor-targeting bacterium that expresses an anti-IL-27 antibody, e.g., a single chain antibody. In some embodiments, the genetically engineered bacterium expresses an anti-IL-27 antibody, e.g., single chain antibody, under the control of a promoter that is activated by low-oxygen conditions. In some embodiments, the genetically engineered bacterium is a tumor-targeting bacterium that expresses an anti-IL-27 antibody, e.g., a single chain antibody under the control of a promoter that is activated by low-oxygen conditions. In some embodiments, the genetically engineered bacterium expresses an anti-IL-27 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-IL-27 antibody, e.g., single chain antibody, under the control of a cancer-specific promoter, a tissue-specific promoter, or a constitutive promoter, such as any of the promoters described herein.

Interleukin 35 (IL-35) is an IL-12 family cytokine produced by regulatory T cell (Tregs), but not effector T-cells and plays a role in immune suppression. It is a dimeric protein composed of IL-12α and IL-27β chains, which are encoded by two separate genes. IL-35 is an immunosuppressive cytokine, predominantly expressed by Tregs and is involved in suppression of anti-tumor immunity through its modulation of effector T cells, as well as myeloid cells. Upon secretion by Tregs, IL-35 suppresses inflammatory responses of immune cells. IL-35 has shown selective activities on different T-cell subsets, inducing proliferation of Treg cell populations but reducing the activity of Th17 cell populations, resulting in a suppressive effect. Blocking the activity of IL-35 has the potential to reverse immune suppression in the tumor microenvironment and lead to a robust and effective anti-tumor immune response.

In certain embodiments, the genetically engineered bacteria produce an anti-cancer molecule that indirectly or directly inhibits IL-35, for example, the genetically engineered microorganism may encode an antibody directed against IL-35, e.g. a single-chain antibody against IL-35. In some embodiments, the genetically engineered bacterium is a tumor-targeting bacterium that expresses an anti-IL-35 antibody, e.g., a single chain antibody. In some embodiments, the genetically engineered bacterium expresses an anti-IL-35 antibody, e.g., single chain antibody, under the control of a promoter that is activated by low-oxygen conditions. In some embodiments, the genetically engineered bacterium is a tumor-targeting bacterium that expresses an anti-IL-35 antibody, e.g., a single chain antibody, under the control of a promoter that is activated by low-oxygen conditions. In some embodiments, the genetically engineered bacterium expresses an anti-IL-35 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-IL-35 antibody, e.g., single chain antibody, under the control of a cancer-specific promoter, a tissue-specific promoter, or a constitutive promoter, such as any of the promoters described herein.

Colony stimulating factor 1 receptor (CSF1R, also known as macrophage colony-stimulating factor receptor, M-CSFR, Cluster of Differentiation 115, CD115) is a single pass type I membrane protein and acts as the receptor for colony stimulating factor 1 (CSF1), a cytokine which plays an essential role in regulating the survival, proliferation, differentiation, and function of macrophages and monocytes. Tumor-associated macrophages (TAM), monocytic myeloid-derived suppressor cells (MMDSC), and granulocytic MDSCs (G-MDSC) are considered drivers of the immunosuppressive tumor microenvironment. These leukocytes can also promote tumor cell proliferation, confer resistance to cytotoxic stress, and facilitate metastatic dissemination. Blockade of CSF1/CSF1R decreases the number of TAMs and reprograms remaining TAMs to support antigen presentation and bolster T-cell activation within the tumor microenvironment. This, in turn, leads to reduced immune suppression and elevated interferon responses, which restrain tumor progression (Yu Zhu, et al., Cancer Res Sep. 15, 2014 74).

In certain embodiments, the genetically engineered bacteria produce an anti-cancer molecule that inhibits CSF1 and/or that inhibits CSF1R, for example, the genetically engineered microorganism may encode an antibody directed against CSF1 and/or an antibody directed against CSF1R, e.g. a single-chain antibody against CSF1 and/or a single-chain antibody against CSF1R. In some embodiments, the genetically engineered bacterium is a tumor-targeting bacterium that expresses an anti-CSF1 antibody and/or an anti-CSF1R antibody, e.g., a single chain antibody. In some embodiments, the genetically engineered bacterium expresses an anti-CSF1 antibody and/or an anti-CSF1R antibody, e.g., single chain antibody, under the control of a promoter that is activated by low-oxygen conditions. In some embodiments, the genetically engineered bacterium is a tumor-targeting bacterium that expresses an anti-CSF1 antibody and/or anti-CSF1R antibody, e.g., a single chain antibody, under the control of a promoter that is activated by low-oxygen conditions. In some embodiments, the genetically engineered bacterium expresses an anti-CSF1 antibody and/or an anti-CSF1R antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CSF1 antibody and/or an anti-CSF1R antibody, e.g., single chain antibody, under the control of a cancer-specific promoter, a tissue-specific promoter, or a constitutive promoter, such as any of the promoters described herein.

Monocyte chemoattractant protein 1 (MCP-1, CCL2) is a member of the cytokine/chemokine superfamily. CCL2 was first characterized as a chemokine which induces the migration of monocytes (Loberg et al., CCL2 is an important mediator of prostate cancer growth in vivo via regulation of macrophage infiltration. Neoplasia. 2007; 9:556-62). et al., 2010). Monocytes recruited to tumors through the CCL2-CCR2 axis are polarized to TAMs, contributing to tumor cell survival (McClellan et al., 2012). In addition, CCL2 has been found to exert a number of other chemotactic properties that include attraction of subsets of lymphocytes (including T-regs) and endothelial cells into sites of inflammation. CCL2 also directly affects T-cell function by inhibiting CD8+ T cell effector functions (Hu K. et a., Recombined CC chemokine ligand 2 into B16 cells induces production of Th2-dominated cytokines and inhibits melanoma metastasis. Immunology Letters. 2007; 113:19-28). Recently, an additional role for CCL2 as a regulator of MDSC accumulation and MDSC-mediated suppression of CD4+ and CD8+ T cells has been described in colorectal cancer. The outcomes in this study suggest an CCL2-MDSC immune checkpoint at the earliest stage of tumor development, which is susceptible to CCL2-directed blockade and potential CCL-2 directed therapy (Chun et al., CCL2 Promotes Colorectal Carcinogenesis by Enhancing Polymorphonuclear Myeloid-Derived Suppressor Cell Population and Function Cell Reports 12, 244-257). In patients, CCL2 has been found at high levels in multiple tumor types which correlate with poor clinical outcome. Studies, such as those by Loberg et al., showed that systemic administration of anti-CCL2 neutralizing antibodies significantly retarded tumor growth. The use of a combination of two antibodies directed against the two mouse CCL2 mouse proteins has been recently shown to reduce tumorigenesis and metastasis in prostate cancer xenograft models. In particular, anti-CCL2 therapy has been suggested to be useful in combination with immunostimulatory therapy such as vaccine therapy (Fridlender, et al., Cancer Res. 2010 Jan. 1; 70(1): 109. CCL2 Blockade Augments Cancer Immunotherapy).

In certain embodiments, the genetically engineered bacteria produce an anti-cancer molecule that inhibits CCL2, for example, the genetically engineered microorganism may encode an antibody directed against CCL2, e.g. a single-chain antibody against CCL2. In some embodiments, the genetically engineered bacterium is a tumor-targeting bacterium that expresses an anti-CCL2 antibody, e.g., a single chain antibody. In some embodiments, the genetically engineered bacterium expresses an anti-CCL2 antibody, e.g., single chain antibody, under the control of a promoter that is activated by low-oxygen conditions. In some embodiments, the genetically engineered bacterium is a tumor-targeting bacterium that expresses an anti-CCL2 antibody, e.g., a single chain antibody under the control of a promoter that is activated by low-oxygen conditions. In some embodiments, the genetically engineered bacterium expresses an anti-CCL2 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CCL2 antibody, e.g., single chain antibody, under the control of a cancer-specific promoter, a tissue-specific promoter, or a constitutive promoter, such as any of the promoters described herein.

CD70 is a cytokine that is a type II transmembrane glycoprotein belonging to the tumor necrosis factor (TNF) superfamily of molecules. Upon binding of its ligand CD27, it promotes proliferation, survival and differentiation of cells. Expression of CD70 is normally restricted to activated T and B cells, but is expressed in certain tumor cells, and has been implicated in tumor cell and Treg cell survival through interaction with CD27. The constitutive expression of CD70 by tumor cells is thought to allow evasion of the immune system by increasing the amount of suppressive Tregs, by induction of T cell apoptosis and by skewing T cells towards T cell exhaustion. It has been shown that inhibition of CD70 can abolish its immune inhibitory effects in the tumor-microenvironment. (CD70: An emerging target in cancer immunotherapy, Jacobs et al., Pharmacology & Therapeutics, Volume 155, November 2015, Pages 1-10).

In certain embodiments, the genetically engineered bacteria produce an anti-cancer molecule that inhibits CD70 and/or CD27, for example, the genetically engineered microorganism may encode an antibody directed against CD70 and/or CD27, e.g. a single-chain antibody against CD70 and/or a single-chain antibody against CD27. In some embodiments, the genetically engineered bacterium is a tumor-targeting bacterium that expresses an anti-CD70 and/or an anti-CD27 antibody, e.g., a single chain antibody. In some embodiments, the genetically engineered bacterium expresses an anti-CD70 antibody and/or an anti-CD27 antibody, e.g., single chain antibody, under the control of a promoter that is activated under low oxygen conditions. In some embodiments, the genetically engineered bacterium is a tumor-targeting bacterium that expresses an anti-CD70 antibody and/or anti-CD27 antibody, e.g., a single chain antibody under the control of a promoter that is activated by low-oxygen conditions. In some embodiments, the genetically engineered bacterium expresses an anti-CD70 antibody and/or an antiCD27 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CD70 antibody and/or an anti-CD27 antibody, e.g., single chain antibody, under the control of a cancer-specific promoter, a tissue-specific promoter, or a constitutive promoter, such as any of the promoters described herein.

Three TGF-β isoforms (TGF-β1, TGF-β2, and TGF-β3) with similar function exist in mammals; TGF-β1 is the isoform predominantly expressed in the immune system. In addition to its direct effects on tumor cell proliferation and angiogenesis, TGF-β enables tumors to evade immune surveillance (see, e.g., Wrzesinski et al., Clin Cancer Res Sep. 15, 2007 13; 5262Transforming Growth Factor-β and the Immune Response: Implications for Anticancer Therapy). As a pleiotropic cytokine, TGF-β exerts its effects on multiple immune cell types. For example, TGF-β can block the production of IL-2, thereby blocking the proliferation of T cells and NK cells. In addition, TGF-β also controls T-cell effector functions by inhibiting the expression of CD8+ effector molecules, such as IFN-γ and perforin and also promotes the generation of Tregs. Finally, TGF-β is thought to negatively regulate regulates the antigen presentation function of differentiated dendritic cells.

In certain embodiments, the genetically engineered bacteria produce an anti-cancer molecule that inhibits TGF-β, for example, the genetically engineered microorganism may encode a neutralizing antibody directed against TGF-β, e.g. a single-chain antibody against TGF-β. In some embodiments, the genetically engineered bacterium is a tumor-targeting bacterium that expresses an anti-TGF-β antibody, e.g., a single chain antibody. In some embodiments, the genetically engineered bacterium expresses an anti-TGF-β antibody, e.g., single chain antibody, under the control of a promoter that is activated under low oxygen conditions. In some embodiments, the genetically engineered bacterium is a tumor-targeting bacterium that expresses an anti-TGF-β antibody, e.g., a single chain antibody under the control of a promoter that is activated by low-oxygen conditions. In some embodiments, the genetically engineered bacterium expresses an anti-TGF-β antibody e.g., single chain antibody, under the control of a promoter that is activated by hypoxic conditions, or by inflammatory conditions, such as any of the promoters activated by said conditions and described herein. In some embodiments, the genetically engineered bacteria expresses an anti-TGF-β antibody, e.g., single chain antibody, under the control of a cancer-specific promoter, a tissue-specific promoter, or a constitutive promoter, such as any of the promoters described herein.

Th1/CD8-Attracting Chemokines

Chemokines are critical for attracting and recruiting immune cells, e.g., those that activate immune response and those that induce cancer cell apoptosis. Target cells of chemokines express corresponding receptors to which chemokines bind and mediate function. Therefore, the receptors of CC and CXC chemokine are referred to as CCRs and CXCRs, respectively. CC chemokines bind to CC chemokine receptors, and CXC chemokines bind to CXC chemokine receptors. Most receptors usually bind to more than one chemokine, and most chemokines usually bind to more than one receptor.

The chemokine interferon-γ inducible protein 10 kDa (CXCL10) is a member of the CXC chemokine family which binds to the CXCR3 receptor to exert its biological effects. CXCL10 is involved in chemotaxis, induction of apoptosis, regulation of cell growth and mediation of angiostatic effects. CXCL10 is associated with a variety of human diseases including infectious diseases, chronic inflammation, immune dysfunction, tumor development, metastasis and dissemination. More importantly, CXCL10 has been identified as a major biological marker mediating disease severity and may be utilized as a prognostic indicator for various diseases. In this review, we focus on current research elucidating the emerging role of CXCL10 in the pathogenesis of cancer. Understanding the role of CXCL10 in disease initiation and progression may provide the basis for developing CXCL10 as a potential biomarker and therapeutic target for related human malignancies.

CXCL10 and CXCL9 each specifically activate a receptor, CXCR3, which is a seven trans-membrane-spanning G protein-coupled receptor predominantly expressed on activated T lymphocytes (Th1), natural killer (NK) cells, inflammatory dendritic cells, macrophages and B cells. The interferon-induced angiostatic CXC chemokines and interferon-inducible T-cell chemoattractant (I-TAC/CXCL11), also activate CXCR3. These CXC chemokines are preferentially expressed on Th1 lymphocytes.

Immune-mediated, tissue-specific destruction has been associated with Th1 polarization, related chemokines (CXCR3 and CCR5 ligands, such as CXCL10 and CXCL9), and genes associated with the activation of cytotoxic mechanisms. Other studies have shown that long disease-free survival and overall survival in cancers such as early-stage breast cancer, colorectal, lung, hepatocellular, ovarian, and melanoma are consistently associated with the activation of T helper type 1 (Th1) cell-related factors, such as IFN-gamma, signal transducers and activator of transcription 1 (STA1), IL-12, IFN-regulatory factor 1, transcription factor T-bet, immune effector or cytotoxic factors (granzymes), perforin, and granulysin, CXCR3 and CCR6 ligand chemokines (CXCL9, CXCL10, and CCL5), other chemokines (CXCL1 and CCL2), and adhesion molecules (MADCAM1, ICAM1, VCAM1). Chemoattraction and adhesion has been shown to play a critical role in determining the density of intratumoral immune cells. Other studies have shown that up-regulation of CXCL9, CXCL10, and CXCL11 is predictive of treatment responsiveness (particular responsive to adoptive-transfer therapy). Still other studies have shown that chemokines that drive tumor infiltration by lymphocytes predicts survival of patients with hepatocellular carcinoma.

It is now recognized that cancer progression is regulated by both cancer cell-intrinsic and microenvironmental factors. It has been demonstrated that the presence of T helper 1 (Th1) and/or cytotoxic T cells correlates with a reduced risk of relapse in several cancers and that a pro-inflammatory tumor microenvironment correlates with prolonged survival in a cohort of patients with hepatocellular carcinoma. CXCL10, CCL5, and CCL2 expression has been shown to correlate with tumor infiltration by Th1, $CD8^+$ T cells, and natural killer cells. Data shows that CXCL10, CCL5, and CCL2 are the main chemokines attracting Th1, $CD8^+$ T cells, and NK cells into the tumor microenvironment. Also, CXCL10 and TLR3 (induces CXCL 10, CCL5, and CCL2) expression correlates with cancer cell apoptosis.

C—X—C motif chemokine 10 (CXCL10), also known as Interferon gamma-induced protein 10 (IP-10) or small-inducible cytokine B10 is an 8.7 kDa protein that in humans is encoded by the CXCL10 gene. CXCL10 is a small cytokine belonging to the CXC chemokine family which is secreted by several cell types in response to IFN-γ, including monocytes, endothelial cells and fibroblasts. CXCL10 plays several roles, including chemoattraction for monocytes/macrophages, T cells, NK cells, and dendritic cells, promotion of T cell adhesion to endothelial cells, antitumor activity, and inhibition of bone marrow colony formation and angiogenesis. This chemokine elicits its effects by binding to the cell surface chemokine receptor CXCR3.

Under proinflammatory conditions CXCL10 is secreted from a variety of cells, such as leukocytes, activated neutrophils, eosinophils, monocytes, epithelial cells, endothelial cells, stromal cells (fibroblasts) and keratinocytes in response to IFN-γ. This crucial regulator of the interferon response, preferentially attracts activated Th1 lymphocytes to the area of inflammation and its expression is associated with Th1 immune responses. CXCL10 is also a chemoattractant for monocytes, T cells and NK cells. (Chew et al., Gut, 2012, 61:427-438. Still other studies have shown that immune-protective signature genes, such as Th1-type chemokines CXCL10 and CXCL9, may be epigenetically silenced in cancer. (Peng et al., Nature, 2015, doi:10.1038/nature 15520).

Chemokine (C—X—C motif) ligand 9 (CXCL9) is a small cytokine belonging to the CXC chemokine family that is also known as Monokine induced by gamma interferon (MIG). CXCL9 is a T-cell chemoattractant (Th1/CD8-attracting chemokine) which is induced by IFN-γ. It is closely related to two other CXC chemokines, CXCL10 and CXCL11. CXCL9, CXCL10 and CXCL11 all elicit their chemotactic functions by interacting with the chemokine receptor CXCR3.

In some embodiments, the engineered bacteria comprise gene sequence encoding one or more chemokines that are Th1/CD8-attracting chemokines. In some embodiments, the engineered bacteria comprise gene sequence encoding one or more chemokines that are CXCR3 ligand chemokines. In some embodiments, the engineered bacteria comprise gene sequence encoding one or more chemokines that are CCR5 ligand chemokines. In some embodiments, the engineered bacteria comprise gene sequence encoding one or more copies of CXCL10.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CXCL10 than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more CXCL10 than unmodified bacteria of the same bacterial subtype under the same conditions. In yet another embodiment, the genetically engineered bacteria produce at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CXCL10 than unmodified bacteria of the same bacterial subtype under the same conditions.

In any of these embodiments, the bacteria genetically engineered to produce CXCL10 secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CXCL10 than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more CXCL10 than unmodified bacteria of the same bacterial subtype under the same conditions. In yet another embodiment, the genetically engineered bacteria secrete at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CXCL10 than unmodified bacteria of the same bacterial subtype under the same conditions.

In some embodiments, the bacteria genetically engineered to secrete CXCL10 are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CXCL10 are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CXCL10 are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL10 are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL10 are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL10 are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to produce CXCL10 are capable of attracting activated Th1 lymphocytes to at least about 10%, 20%, 25%, 30%, 40%, 50%, 60%, 70%, 75%, 80%, 85%, 90%, 95%, or greater extent as compared to an unmodified bacteria of the same subtype under the same conditions. In some embodiments, the bacteria genetically engineered to CXCL10 are capable of attracting activated Th1 lymphocytes to at least about 10%, 20%, 25%, 30%, 40%, 50%, 60%, 70%, 75%, 80%, 85%, 90%, 95%, or greater extent as compared to an unmodified bacteria of the same subtype under the same conditions. In yet another embodiment, the genetically engineered bacteria attract activated Th1 lymphocytes to at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria attract activated Th1 lymphocytes to about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL10 are capable of promoting chemotaxis of T cells by at least about 10%, 20%, 25%, 30%, 40%, 50%, 60%, 70%, 75%, 80%, 85%, 90%, 95%, or greater extent as compared to an unmodified bacteria of the same subtype under the same conditions. In yet another embodiment, the genetically engineered bacteria promote chemotaxis of T cells by at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria promote chemotaxis of T cells about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL10 are capable of promoting chemotaxis of NK cells to at least about 10%, 20%, 25%, 30%, 40%, 50%, 60%, 70%, 75%, 80%, 85%, 90%, 95%, or greater extent as compared to an unmodified bacteria of the same subtype under the same conditions. In yet another embodiment, the genetically engineered bacteria promote chemotaxis of NK cells by at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria promote chemotaxis of NK cells at least about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL10 are capable of binding to CXCR3 by at least about 10%, 20%, 25%, 30%, 40%, 50%, 60%, 70%, 75%, 80%, 85%, 90%, 95%, or greater affinity as compared to an unmodified bacteria of the same subtype under the same conditions. In yet another embodiment, the genetically engineered bacteria bind to CXCR3 with at least about 1.0-1.2-fold, 1.2-1.4-fold, 1.4-1.6-fold, 1.6-1.8-fold, 1.8-2-fold, or two-fold greater affinity than unmodified bacteria of the same bacterial subtype under the same conditions. In yet another embodiment, the genetically engineered bacteria are capable of promoting chemotaxis of T cells to at least about a three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the genetically engineered bacteria comprise a gene sequence encoding a CXCL10 polypeptide, or a fragment or functional variant thereof. In one embodiment, the gene sequence encoding CXCL10 polypeptide has at least about 80% identity with a sequence selected from SEQ ID NO: 1207 or SEQ ID NO: 1208. In another embodiment, the gene sequence encoding CXCL10 polypeptide has at least about 85% identity with a sequence selected from SEQ ID NO: 1207 or SEQ ID NO: 1208. In one embodiment, the gene sequence encoding CXCL10 polypeptide has at least about 90% identity with a sequence selected from SEQ ID NO: 1207 or SEQ ID NO: 1208. In one embodiment, the gene sequence CXCL10 polypeptide has at least about 95% identity with a sequence selected from SEQ ID NO: 1207 or SEQ ID NO: 1208. In another embodiment, the gene sequence encoding CXCL10 polypeptide has at least about 96%, 97%, 98%, or 99% identity with a sequence selected from SEQ ID NO: 1207 or SEQ ID NO: 1208. Accordingly, in one embodiment, the gene sequence encoding CXCL10 polypeptide has at least about 80%, 81%, 82%, 83%, 84%, 85%, 86%, 87%, 88%, 89%, 90%, 91%, 92%, 93%, 94%, 95%, 96%, 97%, 98%, or 99% identity with a sequence selected from SEQ ID NO: 1207 or SEQ ID NO: 1208. In another embodiment, the gene sequence encoding CXCL10 polypeptide comprises a sequence selected from SEQ ID NO: 1207 or SEQ ID NO: 1208. In yet another embodiment, the gene sequence encoding CXCL10 polypeptide consists of a sequence selected from SEQ ID NO: 1207 or SEQ ID NO: 1208. In any of these embodiments wherein the genetically engineered bacteria encode CXCL10, one or more of the sequences encoding a secretion tag may be removed and replaced by a different tag.

In some embodiments, the genetically engineered bacteria comprise a gene sequence encoding a CXCL10 polypeptide having at least about 80% identity with a sequence selected from SEQ ID NO: 1205 or SEQ ID NO: 1206. In some embodiments, the genetically engineered bacteria comprise a gene sequence encoding a CXCL10 polypeptide that has about having at least about 90% identity with a sequence selected from SEQ ID NO: 1205 or SEQ ID NO: 1206. In some embodiments, the genetically engineered bacteria comprise a gene sequence encoding CXCL10 polypeptide that has about having at least about 95% identity with a sequence selected from SEQ ID NO: 1205 or SEQ ID NO: 1206. In some embodiments, the genetically engineered bacteria comprise a gene sequence encoding a CXCL10 polypeptide that has about 80%, 81%, 82%, 83%, 84%, 85%, 86%, 87%, 88%, 89%, 90%, 91%, 92%, 93%, 94%, 95%, 96%, 97%, 98%, or 99% identity to a sequence selected from SEQ ID NO: 1205 or SEQ ID NO: 1206, or a functional fragment thereof. In another embodiment, the CXCL10 polypeptide comprises a sequence selected from SEQ ID NO: 1205 or SEQ ID NO: 1206. In yet another embodiment, the CXCL10 polypeptide expressed by the genetically engineered bacteria consists of a sequence selected from SEQ ID NO: 1205 or SEQ ID NO: 1206. In any of these embodiments wherein the genetically engineered bacteria encode CXCL10 polypeptide, the secretion tag may be removed and replaced by a different secretion tag.

In some embodiments, the genetically engineered microorganisms are capable of expressing any one or more of the described CXCL10 circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding CXCL10 are controlled by a promoter inducible by such conditions and/or inducers. In some embodiments, the gene sequences(s) encoding CXCL10 are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding CXCL10 are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In some embodiments, the CXCL10 is secreted. In some embodiments, the genetically engineered bacteria comprising the gene sequence(s) encoding CXCL10 comprise a secretion tag selected from PhoA, OmpF, cvaC, TorA, FdnG, DmsA, and PelB. In some embodiments, the secretion tag is PhoA. In some embodiments, the genetically engineered bacteria further comprise one or more deletions in an outer membrane protein selected from lpp, n1P, tolA, and PAL. In some embodiments, the deleted or mutated outer membrane protein is PAL. In some embodiments, the genetically engineered bacteria comprising gene sequence(s) for the production of CXCL10 further comprise gene sequence(s) encoding IL-15. In some embodiments, IL-15 is secreted. In some embodiments, the gene sequence(s) encoding IL-15 comprise a secretion tag selected from PhoA, OmpF, cvaC, TorA, FdnG, DmsA, and PelB. In some embodiments, the secretion tag is PhoA. In some embodiments, the genetically engineered bacteria further comprise one or more deletions in an outer membrane protein selected from lpp, n1P, tolA, and PAL. In some embodiments, the deleted or mutated outer membrane protein is PAL.

In any of these embodiments, the bacterium may further comprise gene sequence(s) encoding kynureninase. In some embodiments, the kynureninase is from *Pseudomonas fluorescens*. In some embodiments, the bacteria further comprise a mutation or deletion in trpE. In any of these embodiments, the bacteria may further comprise gene sequence(s) for the production of tryptophan. In some embodiments, the gene sequences for the production of tryptophan are selected from trpE, trpD, trpC, trpB, trpA, aroG, and SerA. In some embodiments, aroG is a feedback resistant form of aroG (aroGfbr). In some embodiments, trpE is a feedback resistant form of trpE (trpEfbr). In some embodiments, the genetically engineered bacteria further comprise a mutation or deletion in trpR. In some embodiments, the genetically engineered bacteria further comprise a mutation or deletion in tnaA.

In some embodiments, the engineered bacteria comprise gene sequence encoding one or more copies of CXCL9.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CXCL9 than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more CXCL9 than unmodified bacteria of the same bacterial subtype under the same conditions. In yet another embodiment, the genetically engineered bacteria produce at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CXCL9 than unmodified bacteria of the same bacterial subtype under the same conditions.

In any of these embodiments, the bacteria genetically engineered to produce CXCL9 secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CXCL9 than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more CXCL9 than unmodified bacteria of the same bacterial subtype under the same conditions. In yet another embodiment, the genetically engineered bacteria secrete at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CXCL9 than unmodified bacteria of the same bacterial subtype under the same conditions.

In some embodiments, the bacteria genetically engineered to secrete at least about CXCL9 are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CXCL9 are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CXCL9 are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL9 are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL9 are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CXCL9 are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to produce CXCL9 are capable of attracting activated Th1 lymphocytes to at least about 10%, 20%, 25%, 30%, 40%, 50%, 60%, 70%, 75%, 80%, 85%, 90%, 95%, or greater extent as compared to an unmodified bacteria of the same subtype under the same conditions. In yet another embodiment, the genetically engineered bacteria attract activated Th1 lymphocytes to at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria attract activated Th1 lymphocytes to at least about a three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL9 are capable of promoting chemotaxis of T cells by at least about 10%, 20%, 25%, 30%, 40%, 50%, 60%, 70%, 75%, 80%, 85%, 90%, 95%, or more as compared to an unmodified bacteria of the same subtype under the same conditions. In yet another embodiment, the genetically engineered bacteria promote chemotaxis of T cells to at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria promote chemotaxis of T cells to a at least about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL9 are capable of promoting chemotaxis of NK cells by at least about 10%, 20%, 25%, 30%, 40%, 50%, 60%, 70%, 75%, 80%, 85%, 90%, 95%, or more as compared to an unmodified bacteria of the same subtype under the same conditions. In yet another embodiment, the genetically engineered bacteria promote chemotaxis of NK cells to at least about 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria promote chemotaxis of NK cells to a three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce CXCL9 are capable of binding to CXCR3 by at least about 10%, 20%, 25%, 30%, 40%, 50%, 60%, 70%, 75%, 80%, 85%, 90%, 95%, or greater affinity as compared to an unmodified bacteria of the same subtype under the same conditions. In yet another embodiment, the genetically engineered bacteria bind to CXCR3 with at least 1.0-1.2-fold, 1.2-1.4-fold, 1.4-1.6-fold, 1.6-1.8-fold, 1.8-2-fold, or two-fold greater affinity than unmodified bacteria of the same bacterial subtype under the same conditions. In yet another embodiment, the genetically engineered bacteria are capable of binding to CXCR3 with at least about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater affinity than unmodified bacteria of the same bacterial subtype under the same conditions.

In some embodiments, the genetically engineered microorganisms are capable of expressing any one or more of the described CXCL9 circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding CXCL9 are controlled by a promoter inducible by such conditions and/or inducers. In some embodiments, the gene sequences(s) encoding CXCL9 are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding CXCL9 are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Inhibition of Th2-Type Cytokines

Cytokines are the hormonal messengers responsible for most of the biological effects in the immune system and can be functionally divided into two groups: those that are proinflammatory and those that are essentially anti-inflammatory but that promote allergic responses. T lymphocytes are a major source of cytokines. There are two main subsets of T lymphocytes, distinguished by the presence of cell surface molecules known as CD4 and CD8. T lymphocytes expressing CD4 are also known as helper T cells, and these are regarded as being the most prolific cytokine producers. This subset can be further subdivided into Th1 and Th2, and the cytokines they produce are known as Th1-type cytokines and Th2-type cytokines.

Th2 cells mediate the activation and maintenance of the humoral, or antibody-mediated, immune response against extracellular parasites, bacteria, allergens, and toxins. Th2 cells mediate these functions by producing various cytokines such as IL-4, IL-5, IL-6, IL-9, IL-13, and IL-17E (IL-25) that are responsible for strong antibody production, eosinophil activation, and inhibition of several macrophage functions, thus providing phagocyte-independent protective responses. Th2-type cytokines are also known to polarize macrophages into the M2 type (immunosuppressive type macrophages).

In some embodiments, the engineered bacteria comprise gene sequence encoding one or more molecules that inhibit the production of Th2-type cytokines in the tumor.

In some embodiments, the genetically engineered microorganisms are capable of expressing any one or more of the described Th2-type cytokine inhibitory circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding Th2-type cytokine inhibitory circuits are controlled by a promoter inducible by such conditions and/or inducers. In some embodiments, the gene sequences(s) encoding Th2-type cytokine inhibitory circuits are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding Th2-type cytokine inhibitory circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Myeloid Derived Suppressor Cell Function

Accumulating evidence indicates that myeloid-derived suppressor cells (MDSCs) contribute to cancer immune evasion by suppressing T cell anti-tumor functions and modulating innate immune responses. In many cancers, increased MDSC numbers in the blood correlate with late stage and metastatic burden. MDSCs comprise a heterogeneous population of immature myeloid cells characterized by co-expression of CD11b and Gr-1 and lack features of mature macrophages and dendritic cells in tumor-bearing mice. MDSCs can be divided into two distinct sub-populations, differing in their gene expression profiles and immunosuppressive activities: monocytic MDSCs (Mo-MDSCs) and polymorphonuclear (PMN)-MDSCs, also known as granulocytic (G)-MDSCs (as described in e.g., Chun et al., CCL2 Promotes Colorectal Carcinogenesis by Enhancing Polymorphonuclear Myeloid-Derived Suppressor Cell Population and Function Cell Reports 12, 244-257). These two types of MDSC achieve immune suppression by different means: while both use arginase-1 for their suppressive activity, (PMN)-MDSCs produce high levels of ROS and little, if any, NO; while Mo-MDSCs produced high levels of NO, but little, if any, ROS. Expansion of MDSC in cancer is largely driven by soluble cancer derived cytokines and growth factors, including but not limited to, prostaglandins, GM-CSF, M-CSF, IL-10, IL-6, VEGF, TGFβ, IL-10, IL-12, IL-13, Il-17, PGE2, and TNF. In most cases, JAK/Stat signaling is initiated as reviewed in Condamine et al., 2015 Annu Rev Med. 2015 Jan. 14; 66: 97-110. Regulation of Tumor Metastasis by Myeloid-derived Suppressor Cells, the contents of which is herein incorporated by reference in its entirety.

Mechanisms of MDSC suppression include generation of reactive oxygen species (ROS), Arg-1, and nitric oxide (NO). In addition, recent studies show that peroxynitrite (PNT), resulting from the reaction of superoxide with NO, can cause the nitration of T cell receptor-CD8 complex. This reduces the ability of the TCR to engage with peptide bound class I MHC and prevents the recognition of cancer cells by CD8+ T cells. Moreover, accelerated depletion of L-arginine and cysteine in the tumor microenvironment has been shown to reduce CD3t chain expression, diminish production of IL-2 and IFN-γ, and inhibit of T cell proliferation, Condamine et al., 2015 and references therein). Several studies showed the ability of M-MDSC to induce differentiation and/or proliferation of Tregs using various mechanisms (Condamine et al. 2015 and references therein). Of note, PMN-MDSC did not promote Treg differentiation, were able to inhibit TGF-β induced Treg generation or proliferation. MDSC also have the ability to recruit Tregs to the tumor site, and this ability is dependent on CCR5 (Condamine et al. 2015 and references therein).

In certain embodiments, the genetically engineered bacteria produce an anti-cancer molecule that inhibits the activation, production, development, differentiation, activity and/or migration of MDSCs in the tumor microenvironment. In certain embodiments, the genetically engineered bacteria produce an anti-cancer molecule that initiates, promotes or stimulates the destruction of MDSCs in the tumor microenvironment In certain embodiments, the genetically engineered bacteria produce one or more anti-cancer molecules that inhibit one or more cytokines selected from M-CSF, IL-1β, IL-6, VEGF, TGFβ, IL-10, IL-13, 11-17, PGE2 and combinations thereof. For example, the genetically engineered microorganism may encode an antibody directed against a cytokine selected from M-CSF, IL-1β, IL-6, VEGF, TGFβ, IL-10, IL-13, Il-17, PGE2 and combinations thereof, e.g. a single-chain antibody against one or more of these cytokines. In some embodiments, the genetically engineered bacterium is a tumor-targeting bacterium. In some embodiments, the genetically engineered bacterium expresses one or more of the above-described antibodies, e.g., single chain antibody, under the control of a promoter that is activated by low-oxygen conditions, activated by hypoxic conditions, or activated by inflammatory conditions, such as any of the promoters activated by said conditions and described herein. In some embodiments, the genetically engineered bacteria expresses one or more of the above-described antibodies, e.g., single chain antibody, under the control of a cancer-specific promoter, a tissue-specific promoter, or a constitutive promoter, such as any of the promoters described herein.

Inhibition of Phagocytosis Escape

CD47-SIRPα Pathway

Cancers have the ability to up-regulate the "don't eat me" signal to allow escape from endogenous "eat me" signals that were induced as part of programmed cell death and programmed cell removal, to promote tumor progression.

CD47 is a cell surface molecule implicated in cell migration and T cell and dendritic cell activation. In addition, CD47 functions as an inhibitor of phagocytosis through ligation of signal-regulatory protein alpha (SIRPα) expressed on phagocytes, leading to tyrosine phosphatase activation and inhibition of myosin accumulation at the submembrane assembly site of the phagocytic synapse. As a result, CD47 conveys a "don't eat me signal". Loss of CD47 leads to homeostatic phagocytosis of aged or damaged cells.

Elevated levels of CD47 expression are observed on multiple human tumor types, allowing tumors to escape the innate immune system through evasion of phagocytosis. This process occurs through binding of CD47 on tumor cells to SIRPα on phagocytes, thus promoting inhibition of phagocytosis and tumor survival.

Anti-CD47 antibodies have demonstrated pre-clinical activity against many different human cancers both in vitro and in mouse xenotransplantation models (Chao et al., Curr Opin Immunol. 2012 April; 24(2): 225-232. The CD47-SIRPα Pathway in Cancer Immune Evasion and Potential Therapeutic Implications, and references therein). In addition to CD47, SIRPα can also be targeted as a therapeutic strategy; for example, anti-SIRPα antibodies administered in vitro caused phagocytosis of tumor cells by macrophages (Chao et al., 2012).

In a third approach, CD47-targeted therapies have been developed using the single 14 kDa CD47 binding domain of human SIRPα (a soluble form without the transmembrane portion) as a competitive antagonist to human CD47 (as described in Weiskopf et al., Engineered SIRPα variants as immunotherapeutic adjuvants to anti-cancer antibodies; Science. 2013 Jul. 5; 341(6141): 10.1126/science.1238856, the contents of which is herein incorporated by reference in its entirety). Because the wild type SIRPα showed relatively low affinity to CD47, mutated SIRPα were generated through in vitro evolution via yeast surface display, which were shown to act as strong binders and antagonists of CD47. These variant include CV1 (consensus variant 1) and high-affinity variant FD6, and Fc fusion proteins of these variants. The amino acid changes leading to the increased affinity are located in the d1 domain of human SIRPα. Non limiting examples of SIRPalpha variants are also described in WO/2013/109752, the contents of which is herein incorporated by reference in its entirety.

In certain embodiments, the genetically engineered bacteria produce one or more anti-cancer molecules that inhibit CD47 and/or inhibit SIRPα and/or inhibit or prevent the interaction between CD47 and SIRPα expressed on macrophages. For example, the genetically engineered microorganism may encode an antibody directed against CD47 and/or an antibody directed against SIRPα, e.g. a single-chain antibody against CD47 and/or a single-chain antibody against SIRPα. In another non-limiting example, the genetically engineered microorganism may encode a competitive antagonist polypeptide comprising the SIRPα CD47 binding domain. Such a competitive antagonist polypeptide can function through competitive binding of CD47, preventing the interaction of CD47 with SIRPα expressed on macrophages. In some embodiments, the competitive antagonist polypeptide is soluble, e.g., is secreted from the microorganism. In some embodiments, the competitive antagonist polypeptide is displayed on the surface of the microorganism. In some embodiments, the genetically engineered microorganism encoding the competitive antagonist polypeptide encodes a wild type form of the SIRPα CD47 binding domain. In some embodiments, the genetically engineered microorganism encoding the competitive antagonist polypeptide encodes a mutated or variant form of the SIRPalpha CD47 binding domain. In some embodiments, the variant form is the CV1 SIRPα variant. In some embodiments, the variant form is the FD6 variant. In some embodiments, the SIRPα variant is a variant described in Weiskopf et al., and/or International Patent Publication WO/2013/109752. In some embodiments, the genetically engineered microorganism encoding the competitive antagonist polypeptide encodes a SIRPα CD47 binding domain or variant thereof fused to a stabilizing polypeptide. In some embodiments, the genetically engineered microorganism encoding the competitive antagonist polypeptide encodes a wild type form of the SIRPα CD47 binding domain fused to a stabilizing polypeptide. In a non-limiting example, the stabilizing polypeptide fused to the wild type SIRPα CD47 binding domain polypeptide is a Fc portion. In some embodiments, the stabilizing polypeptide fused to the wild type SIRPα CD47 binding domain polypeptide is the IgG Fc portion. In some embodiments, the stabilizing polypeptide fused to the wild type SIRPα CD47 binding domain polypeptide is the IgG4 Fc portion. In some embodiments, the genetically engineered microorganism encoding the competitive antagonist polypeptide encodes a mutated or variant form of the SIRPalpha CD47 binding domain fused to a stabilizing polypeptide. In some embodiments, the variant form fused to the stabilizing polypeptide is the CV1 SIRPα variant. In some embodiments, the variant form fused to the stabilizing polypeptide is the F6 variant. In some embodiments, the SIRPα variant fused to the stabilizing polypeptide is a variant described in Weiskopf et al., and/or International Patent Publication WO/2013/109752. In a non-limiting example, the stabilizing polypeptide fused to the variant SIRPα CD47 binding domain polypeptide is a Fc portion. In some embodiments, the stabilizing polypeptide fused to the variant SIRPα CD47 binding domain polypeptide is the IgG Fc portion. In some embodiments, the stabilizing polypeptide fused to the variant SIRPalpha CD47 binding domain polypeptide is an IgG4 Fc portion.

In some embodiments, the genetically engineered bacterium is a tumor-targeting bacterium that expresses an anti-CD47 antibody and/or anti-SIRPα antibody, e.g., a single chain antibody. In some embodiments, the genetically engineered bacterium is a tumor-targeting bacterium that expresses competitive antagonist SIRPα CD47 binding domain (WT or mutated to improve CD47 affinity). In some embodiments, the genetically engineered bacterium is a tumor-targeting bacterium that expresses an anti-CD47 antibody and/or anti-SIRPα antibody, e.g., a single chain antibody, under the control of a promoter that is activated by low-oxygen conditions. In some embodiments, the genetically engineered bacterium expresses a competitive antagonist SIRPα CD47 binding domain (WT or mutated variant with improved CD47 affinity) under the control of a promoter that is activated by low-oxygen conditions. In some embodiments, the genetically engineered bacterium expresses an anti-CD47 antibody and/or an anti-SIRPα, e.g., single chain antibody, under the control of a promoter that is activated by hypoxic conditions, or by inflammatory conditions, such as any of the promoters activated by said conditions and described herein. In some embodiments, the genetically engineered bacterium expresses a competitive antagonist SIRPα CD47 binding domain (WT or mutated variant with improved CD47 affinity) under the control of a promoter that is activated by hypoxic conditions, or by inflammatory conditions, such as any of the promoters activated by said conditions and described herein. In some embodiments, the genetically engineered bacteria expresses an anti-CD47 antibody and/or an anti-SIRPα antibody, e.g., single chain antibody, under the control of a cancer-specific promoter, a tissue-specific promoter, or a constitutive promoter, such as any of the promoters described herein. In some embodiments, the genetically engineered bacteria comprise one or more genes encoding a competitive antagonist SIRPα CD47 binding domain (WT or mutated variant with improved CD47 affinity) under the control of a cancer-specific promoter, a tissue-specific promoter, or a constitutive promoter, such as any of the promoters described herein. In any of these embodiments, the genetically engineered microorganisms may also produce one or more anti-cancer molecules that are capable of stimulating Fc-mediated functions such as ADCC, and/or M-CSF and/or GM-CSF, resulting in a blockade of phagocytosis inhibition.

The genetically engineered bacteria and/or other microorganisms may comprise one or more genes encoding any suitable anti-CD47 antibody, anti-SIRPα antibody or competitive SIRPα CD47 binding domain polypeptide (wild type or mutated variant with improved CD47 binding affinity) for the inhibition or prevention of the CD47-SIRPα interaction. In some embodiments, the antibody(ies) or competitive polypeptide(s) is modified and/or mutated, e.g., to enhance stability, increase CD47 antagonism. In some embodiments, the genetically engineered bacteria and/or other microorganisms are capable of producing the antibody(ies) or competitive polypeptide(s) under inducing conditions, e.g., under a condition(s) associated with immune suppression and/or tumor microenvironment. In some embodiments, the genetically engineered bacteria and/or other microorganisms are capable of producing the antibody(ies) or competitive polypeptide(s) in low-oxygen conditions or hypoxic conditions, in the presence of certain molecules or metabolites, in the presence of molecules or metabolites associated with cancer, or certain tissues, immune suppression, or inflammation, or in the presence of some other metabolite that may or may not be present in the gut, circulation, or the tumor, such as arabinose.

In some embodiments, the genetically engineered bacteria comprise an anti-CD47 gene sequence encoding B6H12-anti-CD47-scFv. In some embodiments, the genetically engineered bacteria encode a polypeptide which is at least about 80%, at least about 85%, at least about 90%, at least about 95%, or at least about 99% homologous to SEQ ID NO: 994. In some embodiments, the genetically engineered bacteria encode a polypeptide comprising SEQ ID NO: 994. In some embodiments, the genetically engineered bacteria encode a polypeptide consisting of SEQ ID NO: 994. In some embodiments, the genetically engineered bacteria comprise an anti-CD47 gene sequence encoding 5F9-anti-CD47-scFv. In some embodiments, the genetically engineered bacteria encode a polypeptide which is at least about 80%, at least about 85%, at least about 90%, at least about 95%, or at least about 99% homologous to a sequence selected from SEQ ID NO: 996. In some embodiments, the genetically engineered bacteria encode a polypeptide comprising SEQ ID NO: 996. In some embodiments, the genetically engineered bacteria encode a polypeptide consisting of SEQ ID NO: 996. In some embodiments, the genetically engineered bacteria comprise an anti-CD47 gene sequence encoding 5F9antihCD47scFv-V5-HIS. In some embodiments, the Anti-CD47 scFv sequences is at least about 80%, at least about 85%, at least about 90%, at least about 95%, or at least about 99% homologous to a sequence selected from SEQ ID NO: 993 and SEQ ID NO: 995, excluding the non-coding regions and sequences coding for tags. In some embodiments, the gene sequence comprises a sequence selected from SEQ ID NO: 993 and SEQ ID NO: 995, excluding the non-coding regions and sequences coding for tags. In some embodiments, the gene sequence consists of a sequence selected from SEQ ID NO: 993 and SEQ ID NO: 995, excluding the non-coding regions and sequences coding for tags.

In some embodiments, the genetically engineered bacteria comprise a gene sequence encoding a SIRPalpha polypeptide having at least about 80% identity with a sequence selected from SEQ ID NO: 1118, SEQ ID NO: 1231, SEQ ID NO: 1119, SEQ ID NO: 1120. In some embodiments, the genetically engineered bacteria comprise a gene sequence encoding a SIRPalpha polypeptide having at least about 90% identity with a sequence selected from SEQ ID NO: 1118, SEQ ID NO: 1231, SEQ ID NO: 1119, SEQ ID NO: 1120. In some embodiments, the genetically engineered bacteria comprise a gene sequence encoding a SIRPalpha polypeptide having at least about 95% identity with a sequence selected from SEQ ID NO: 1118, SEQ ID NO: 1231, SEQ ID NO: 1119, SEQ ID NO: 1120. In some embodiments, the genetically engineered bacteria comprise a gene sequence encoding a SIRPalpha polypeptide that has about 80%, 81%, 82%, 83%, 84%, 85%, 86%, 87%, 88%, 89%, 90%, 91%, 92%, 93%, 94%, 95%, 96%, 97%, 98%, or 99% identity a to a sequence selected from SEQ ID NO: 1118, SEQ ID NO: 1231, SEQ ID NO: 1119, SEQ ID NO: 1120, or a functional fragment thereof. In another embodiment, the SIRPalpha polypeptide comprises a sequence selected from SEQ ID NO: 1118, SEQ ID NO: 1231, SEQ ID NO: 1119, and SEQ ID NO: 1120. In yet another embodiment, the polypeptide expressed by the genetically engineered bacteria consists of a sequence selected from SEQ ID NO: 1118, SEQ ID NO: 1231, SEQ ID NO: 1119, and SEQ ID NO: 1120.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions.

In any of these embodiments, the bacteria genetically engineered to produce SIRPalpha, SIRPalpha variant (e.g., CV1 or FD6 variant), or SIRPalpha-fusion protein (e.g., SIRPalpha IgG Fc fusion protein) secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions. In yet another embodiment, the genetically engineered bacteria secrete three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more SIRPalpha, SIRPalpha variant (e.g., CV1 or FD6 variant), or SIRPalpha-fusion protein (e.g., SIRPalpha IgG Fc fusion protein) than unmodified bacteria of the same bacterial subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce secrete SIRPalpha, SIRPalpha variant (e.g., CV1 or FD6 variant), or SIRPalpha-fusion protein (e.g., SIRPalpha IgG Fc fusion protein) are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete SIRPalpha, SIRPalpha variant (e.g., CV1 or FD6 variant), or SIRPalpha-fusion protein (e.g., SIRPalpha IgG Fc fusion protein) are capable of increasing phagocytosis of tumor cells by at least about 10%, 20%, 25%, 30%, 40%, 50%, 60%, 70%, 75%, 80%, 85%, 90%, 95%, or more as compared to an unmodified bacteria of the same subtype under the same conditions.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more anti-CD47 scFv than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more anti-CD47 scFv than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more anti-CD47 scFv than unmodified bacteria of the same bacterial subtype under the same conditions.

In any of these embodiments, the bacteria genetically engineered to produce anti-CD47 scFv secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more anti-CD47 scFv than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more anti-CD47 scFv than unmodified bacteria of the same bacterial subtype under the same conditions. In yet another embodiment, the genetically engineered bacteria secrete three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more anti-CD47 scFv than unmodified bacteria of the same bacterial subtype under the same conditions.

In some embodiments, the bacteria genetically engineered to secrete anti-CD47 scFv are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete anti-CD47 scFv are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete anti-CD47 scFv are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete anti-CD47 scFv are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete anti-CD47 scFv are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce anti-CD47 scFv are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete anti-CD47 scFv are capable of increasing phagocytosis of tumor cells by at least about 10%, 20%, 25%, 30%, 40%, 50%, 60%, 70%, 75%, 80%, 85%, 90%, 95%, or more as compared to an unmodified bacteria of the same subtype under the same conditions. In yet another embodiment, the genetically engineered bacteria increase phagocytosis of tumor cells by at least 1.0-1.2-fold, 1.2-1.4-fold, 1.4-1.6-fold, 1.6-1.8-fold, 1.8-2-fold, or two-fold more than unmodified bacteria of the same bacterial subtype under the same conditions. In yet another embodiment, the genetically engineered bacteria increase phagocytosis of tumor cells three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more than unmodified bacteria of the same bacterial subtype under the same conditions.

In some embodiments, the genetically engineered bacteria and/or other microorganisms are capable of expressing any one or more of the described circuits in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut or the tumor, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacteria and/or other microorganismal expansion, production and/or manufacture, as described herein.

In some embodiments, any one or more of the described circuits are present on one or more plasmids (e.g., high copy or low copy) or are integrated into one or more sites in the bacteria and/or other microorganism chromosome(s). Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art (7) one or more circuits for the production or degradation of one or more metabolites (e.g., kynurenine, tryptophan, adenosine, arginine) described herein and (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Phosphatidyl Serine Externalization

The redistribution of Phosphatidyl serine (PS) to the external face of the plasma membrane flags cells for their recognition, phagocytosis, and ultimate degradation by phagocytes (efferocytosis). Moreover, the interaction between PS-expressing cells and immune cells triggers immunosuppressive pathways that prevent both local and systemic immune activation. Although these pathways are used by apoptotic cells to quell potential immune sequelae against 'self', these same pathways are hijacked by tumors to evade the immune response.

PS is dysregulated in cancers, and along with the upregulation of PS receptors, provides potent immunosuppression in the tumor microenvironment. In the tumor microenvironment, pro-inflammatory and adaptive immune response are suppressed by several types of PS expressing immature tumor vasculature, tumor-derived exosomes, and tumor cells. Moreover, intra-tumoral DCs that bind and ingest PS-expressing cells maintain an immature phenotype preventing the expression of co-stimulatory molecules that are required for optimum functional antigen presentation and activation of T-cell responses. PS receptors, including the TAM and TIM family of receptors, are expressed on infiltrating myeloid-derived cells where they function to promote tissue homeostasis following inflammatory signaling. In the tumor microenvironment, these receptors are engaged by PS or PS bridging molecules resulting in the expression of immunosuppressive cytokines and the prevention of a productive anti-tumor immune response.

Systemic administration of Annexin A5 (AnxA5) or other PS ligands, PS-targeting antibodies, and agents targeting PS receptors have been shown to slow tumor progression (reviewed in Birge et al., Cell Death and Differentiation advance online publication 26 Feb. 2016; doi: 10.1038/cdd.2016.11Phosphatidylserine is a global immunosuppressive signal in efferocytosis, infectious disease, and cancer).

In certain embodiments, the genetically engineered bacteria produce one or more anti-cancer molecules that inhibit PS and/or inhibit the PS receptor, for example, the genetically engineered microorganism may encode an antibody directed against PS and/or an antibody directed against the PS receptor, e.g. a single-chain antibody against PS and/or a single-chain antibody against the PS receptor. In some embodiments, the genetically engineered bacterium is a tumor-targeting bacterium that expresses an anti-PS antibody and/or an anti-PS receptor antibody, e.g., a single chain antibody. In some embodiments, the genetically engineered bacterium expresses an anti-PS antibody and/or an anti-PS receptor antibody, e.g., single chain antibody, under the control of a promoter that is activated by low-oxygen conditions. In some embodiments, the genetically engineered bacterium is a tumor-targeting bacterium that expresses an anti-PS antibody and/or an anti-PS receptor antibody, e.g., a single chain antibody under the control of a promoter that is activated by low-oxygen conditions.

In certain embodiments, the genetically engineered bacteria produce one or more anti-cancer molecules that inhibit PS signaling through the PS receptor, for example, the genetically engineered microorganism may encode a PS receptor antagonist, e.g. an antagonistic P5 ligand. In certain embodiments, the P5 receptor antagonist is Annexin A5. In some embodiments, the genetically engineered bacterium is a tumor-targeting bacterium that expresses an antagonistic P5 ligand. In some embodiments, the genetically engineered bacterium expresses an antagonistic P5 ligand under the control of a promoter that is activated by low-oxygen conditions. In some embodiments, the genetically engineered bacterium is a tumor-targeting bacterium that expresses an antagonistic P5 ligand under the control of a promoter that is activated by low-oxygen conditions.

In some embodiments, the genetically engineered bacterium expresses an antagonistic ligand for P5 receptor and/or anti-PS antibody and/or an anti-PS receptor antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an antagonistic ligand for P5 receptor and/or anti-PS antibody and/or an anti-PS receptor antibody, e.g., single chain antibody, under the control of a cancer-specific promoter, a tissue-specific promoter, or a constitutive promoter, such as any of the promoters described herein.

Immune Suppression and Angiogenesis and Hypoxia/HIF Regulation

Neovascularization is critical for tumor development as tumors have to establish a blood supply in order to progress. Angiogenesis is the most prominent step in tumor neovascularization. The angiogenic process is regulated by a number of factors, which promote or inhibit endothelial cell activation. Pro-angiogenic factors include VEGF, fibroblast growth factor (FGF), and ANG family members. Angiostatic molecules include thrombospondin-1, endostatin and tumstatin, and certain CXCL chemokines. During tumor angiogenesis, dysregulation leads to an overabundance of pro-angiogenic factors, resulting in uninhibited sprouting and expansion of the endothelium. New vessels arise when such sprouts meet and anastomose, and subsequently vessels stabilize with the formation of a basement membrane and the recruitment of mural cells.

It has become clear that immune cells play a key proangiogenic role and are at least in part responsible for the short-lived response to angiogenesis inhibitors in the clinic (Rivera and Bergers, Trends Immunol. 2015 April; 36(4): 240-9. Intertwined regulation of angiogenesis and immunity by myeloid cells). Hypoxic tumors drive the recruitment and infiltration of several innate immune cell populations through the secretion of a number of cytokines and growth factors. For example, tumor-derived VEGF, CSF-1, MCP-1, and SDF1α recruit macrophages, G-MDSCs and Mo-MDSCs; CXCL2 recruits angiogenic neutrophils and monocytes; ANG2 recruits angiogenic TIE2-expressing monocytes/macrophages (TEMs).

In certain embodiments, the present disclosure provides engineered microorganisms that produce one or more anti-cancer molecules that inhibit the activity of one or more of the following: VEGF, CXCR4/CXCL12, HIF-1 alpha, Galectin, Neutropilin and Tie2.

Additional cytokines secreted by tumor cells include IL-4 and IL-6, which induce the differentiation of infiltrating monocytes into angiogenic and immune-suppressive macrophages. Once recruited into the tumor microenvironment, MDSCs, TAMs, TEMs, and neutrophils secrete or liberate sequestered angiogenic factors, the most prevalent of which is VEGF. The proangiogenic activity of VEGF is predominantly caused through its interaction with VEGFR2 on endothelial cells. In addition, VEGF is also known to inhibit a number of different types of immune cells via multiple mechanisms. For example, VEGF binds to VEGFR1 on $CD34^+$ hematopoietic progenitors and inhibits differentiation into mature dendritic cells through inhibition of NF-κB-signaling, leading to defective antigen presentation (Oyama, et al. J. Immunol., 160 (1998), pp. 1224-1232; Vascular endothelial growth factor affects dendritic cell maturation through the inhibition of nuclear factor-kappa B activation in hemopoietic progenitor cells). In addition, VEGF also induces programmed death ligand 1 (PDL1) expression on dendritic cells inhibiting T cell activation and promoting self-tolerance. Furthermore, VEGF impedes T cell extravasation by limiting T cell adhesion to the luminal surfaces of blood vessels, inhibits the proliferation and cytotoxicity of cytotoxic T lymphocytes (CTLs), and stimulates the proliferation of T regulatory (Treg) cells (e.g., reviewed in Motz, et al., Nat. Rev. Immunol., 11 (2011), pp. 702-711; The parallel lives of angiogenesis and immunosuppression: cancer and other tales).

In certain embodiments, the genetically engineered bacteria produce one or more anti-cancer molecules that inhibit VEGF. In some embodiments, the genetically engineered bacterium is a tumor-targeting bacterium that expresses an anti-VEGF antibody, e.g., a single chain antibody. In some embodiments, the genetically engineered bacterium expresses an anti-VEGF antibody, e.g., single chain antibody, under the control of a promoter that is activated by low-oxygen conditions. In some embodiments, the genetically engineered bacterium is a tumor-targeting bacterium that expresses an anti-VEGF antibody, e.g., a single chain antibody, under the control of a promoter that is activated by low-oxygen conditions. In certain embodiments, the genetically engineered bacteria express an anti-VEGF antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-VEGF antibody, under the control of a cancer-specific promoter, a tissue-specific promoter, or a constitutive promoter, such as any of the promoters described herein. Exemplary anti-VEGF: Heavy and light chains include SEQ ID NO: 124 and 125.

Hypoxia-inducible factor 1-alpha, also known as HIF-1-alpha, is a subunit of a heterodimeric transcription factor hypoxia-inducible factor 1 (HIF-1) that is encoded by the HIF1A gene. HIF-1 is known to induce transcription of more than 60 genes, including VEGF and erythropoietin that are involved in angiogenesis and erythropoiesis, which assist in promoting and increasing oxygen delivery to hypoxic regions. HIF-1 also induces transcription of genes involved in cell proliferation and survival, as well as glucose and iron metabolism. HIF-1 responds to systemic oxygen levels by undergoing conformational changes, and associates with HRE regions of promoters of hypoxia-responsive genes to induce transcription.

Hypoxia within the tumor microenvironment is a key regulator of angiogenesis. This regulation is mediated by the hypoxia-inducible factor (HIF) family of transcription factors. HIFs inter alia orchestrate the metabolic and vascular adaptation to low oxygen. HIF stabilization leads to an upregulation of various proangiogenic growth factors and chemokines including VEGF, PlGF, and ANG2, resulting directly in vessel growth as well as the recruitment of bone-marrow-derived myeloid cells (C. Murdoch, et al. Blood, 104 (2004), pp. 2224-2234; Mechanisms regulating the recruitment of macrophages into hypoxic areas of tumors and other ischemic tissues). VEGF, induced by HIF, activates endothelial cells and attracts myeloid cells, promoting angiogenic properties in these cells (Avraham-Davidi, et al.; J. Exp. Med., 210 (2013), pp. 2611-2625). HIF-1 alpha also induces FoxP3, the Treg transcriptional master regulator. FOXP3 (forkhead box P3) contains putative hypoxia response elements within its promoter, rendering its expression sensitive to HIF-1a activation (Clambey, et al. Proc. Natl. Acad. Sci. U.S.A., 109 (2012), pp. E2784-E2793; Hypoxia-inducible factor-1 alpha-dependent induction of FoxP3 drives regulatory T-cell abundance and function during inflammatory hypoxia of the mucosa).

HIF-1 is overexpressed in many human cancers. HIF-1 overexpression is heavily implicated in promoting tumor growth and metastasis through its role in initiating angiogenesis and regulating cellular metabolism to overcome hypoxia. Significant HIF-1 expression has been noted in most solid tumors studied, including colon, breast, pancreas, kidney, prostate, ovary, brain, and bladder cancers. Clinically, elevated HIF-1a levels in a number of cancers, including cervical cancer, non-small-cell lung carcinoma, breast cancer (LV-positive and negative), oligodendroglioma, oropharyngeal, ovarian cancer, endometrial cancer, esophageal cancer, head and neck cancer, and stomach cancer, have been associated with aggressive tumor progression.

In certain embodiments, the genetically engineered bacteria produce one or more anti-cancer molecules that inhibit HIF, e.g., HIF-1. In some embodiments, the genetically engineered bacterium is a tumor-targeting bacterium that expresses an anti-HIF-1 antibody, e.g., a single chain antibody. In some embodiments, the genetically engineered bacterium expresses an anti-HIF antibody, e.g., single chain antibody, under the control of a promoter that is activated by low-oxygen conditions. In some embodiments, the genetically engineered bacterium is a tumor-targeting bacterium that expresses an anti-HIF antibody, under the control of a promoter that is activated by low-oxygen conditions. In certain embodiments, the genetically engineered bacteria express an anti-HIF antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-HIF antibody, e.g., single chain antibody, under the control of a cancer-specific promoter, a tissue-specific promoter, or a constitutive promoter, such as any of the promoters described herein. In any of these embodiments, the anti-HIF antibody is an anti-HIF-1 antibody. In any of these embodiments, the anti-HIF antibody is an anti-HIF1-alpha (anti-HIF-1a antibody).

Semaphorin3A (SEMA3A) is another hypoxia-induced factor in tumors that is implicated in macrophage recruitment and subsequent angiogenesis. SEMA3A interacts with the transmembrane guidance protein neuropilin 1 (NRP1) on TAMs, leading to VEGFR1 activation and migration into the hypoxic tumor microenvironment (Rivera and Bergers, 2015). Upon arrival, NRP1 is no longer expressed, leading to a loss of their migratory phenotype. TAMs are then reprogrammed to an angiogenic and immune-suppressive phenotype, and produce immune suppressive and pro-angiogenic factors, including ARG1, CCL22, IL-10, VEGF, SEMA3A, and MMP-9 (A. Casazza, et al. Cancer Cell, 24 (2013), pp. 695-709 Impeding macrophage entry into hypoxic tumor areas by Sema3A/Nrp1 signaling blockade inhibits angiogenesis and restores antitumor immunity). The Neuropilin-1 (NRP1) and Neuropilin-2 (NRP2) receptors are transmembrane glycoproteins, and predominantly co-receptors for semaphorins and also function as receptors for some forms of vascular endothelial growth factor (VEGF). For example, VEGF165 binds to both NRP1 and to NRP2.

In certain embodiments, the genetically engineered bacteria produce one or more anti-cancer molecules that inhibit NRP1, NRP2, and/or semaphorin3A. In some embodiments, the genetically engineered bacterium is a tumor-targeting bacterium that expresses an anti-NRP1 antibody and/or an anti-NRP2 antibody, and/or an anti-semaphorin3A antibody, e.g., a single chain antibody. In some embodiments, the genetically engineered bacterium expresses an anti-NRP1 antibody and/or an anti-NRP2 antibody, and/or an anti-semaphorin3A antibody, e.g., single chain antibody, under the control of a promoter that is activated by low-oxygen conditions. In some embodiments, the genetically engineered bacterium is a tumor-targeting bacterium that expresses an anti-anti-NRP1 antibody and/or an anti-NRP2 antibody, and/or an anti-semaphorin3A antibody, under the control of a promoter that is activated by low-oxygen conditions. In certain embodiments, the genetically engineered bacteria expresses an anti-NRP1 antibody and/or an anti-NRP2 antibody, and/or an anti-semaphorin3A antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-NRP1 antibody and/or an anti-NRP2 antibody, and/or an anti-semaphorin3A antibody, e.g., single chain antibody, under the control of a cancer-specific promoter, a tissue-specific promoter, or a constitutive promoter, such as any of the promoters described herein. In any of these embodiments, the antibody is an anti-NRP1 antibody.

Additionally, HIF-1α induces CXCL12 (SDF1α) and its receptor CXCR4, both of which are implicated in the retention of myeloid cells. Recent studies provide strong evidence for the role of the chemokine receptor CXCR4 in the maintenance, dissemination, and consequent metastatic colonization of cancer initiating cells (or cancer stem cells) (Gil et al., J Immunol. 2014; 193(10):5327-37; CXCL12/CXCR4 blockade by oncolytic virotherapy inhibits ovarian cancer growth by decreasing immunosuppression and targeting cancer-initiating cells, and references therein). In ovarian cancer, signals mediated by the CXCL12/CXCR4 axis are centrally involved in progression, as CXCL12 can stimulate ovarian cancer cell migration and invasion through extracellular matrix. CXCL12 produced by tumor tissue and surrounding stroma stimulates VEGF-mediated angiogenesis and the recruitment of endothelial progenitor cells from the bone marrow (Gil et al., and references therein). CXCL12 also was shown to recruit suppressive myeloid cells and dendritic cells at tumor sites and induce intratumoral Treg localization (Gil et al., and references therein). In the study described by Gil et al., oncolytic vaccinia virus (OVV) expressing CXCR4 antagonist metastatic spread of tumors and improved overall survival compared with oncolysis alone in an ovarian cancer model (Gil et al., J Immunol. 2014 15; 193(10):5327-37; CXCL12/CXCR4 blockade by oncolytic virotherapy inhibits ovarian cancer growth by decreasing immunosuppression and targeting cancer-initiating cells). Expression of this receptor in cancer cells has been linked to metastasis to tissues containing a high concentration of CXCL12, such as lungs, liver and bone marrow.

In certain embodiments, the genetically engineered bacteria produce one or more anti-cancer molecules that inhibit CXCR4/CXCL12 receptor/ligand binding. Thus, the genetically engineered bacteria produce one or more anti-cancer molecules that inhibit CXCR4 and/or CXCL12. In some embodiments, the genetically engineered bacterium is a tumor-targeting bacterium that expresses an anti-CXCR4 antibody (antagonistic) and/or an anti-CXCL12 antibody, e.g., a single chain antibody. In some embodiments, the genetically engineered bacterium expresses an anti-CXCR4 antibody (antagonistic) and/or an anti-CXCL12 antibody, e.g., single chain antibody, under the control of a promoter that is activated by low-oxygen conditions. In some embodiments, the genetically engineered bacterium is a tumor-targeting bacterium that expresses an anti-CXCR4 antibody (antagonistic) and/or an anti-CXCL12 antibody, under the control of a promoter that is activated by low-oxygen conditions. In certain embodiments, the genetically engineered bacteria expresses an anti-CXCR4 antibody (antagonistic) and/or an anti-CXCL12 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-CXCR4 antibody (antagonistic) and/or an anti-CXCL12 antibody, e.g., single chain antibody, under the control of a cancer-specific promoter, a tissue-specific promoter, or a constitutive promoter, such as any of the promoters described herein. In any of these embodiments, the antibody is an anti-NRP1 antibody.

Galectins, a family of at least 15 β-galactoside-binding proteins, are involved in growth development as well as cancer progression and metastasis. Galectins are classified into three types: proto, chimera, and tandem repeat. Prototype galectins (Galectins-1, -2, -5, -7, -10, -11, -13, -14, and -15) contain one carbohydrate-recognition domain (CRD) per subunit. Tandem repeat-type galectins (e.g., galectins-4, -6, -8, -9, and -12) contain two CRDs joined by a linker peptide. Galectin-3, the most studied member of the family, is the only representative of the chimera-type galectin, which has one CRD at the C-terminal end. Galectin-3 is expressed in many tumors and possibly plays an important role in tumor progression. Recent studies revealed that galectin-3 inter alia may have immunosuppressive properties and can induce apoptosis of activated T-cells or is responsible for deficient T-cell functions (see, e.g., Ahmed et al., Clin. Med. Insights Oncol. 2015; 9: 113-121; Galectin-3 as a Potential Target to Prevent Cancer Metastasis). Cell surface glycoproteins, such as CD29, CD7, CD95, CD98, and T-cell receptor have been shown to associate with galectin-3, which may mediate induction of apoptosis by extracellular galectin-3. For example, extracellular galectin-3 binds to the CD29/CD7 complex, which triggers the activation of an intracellular apoptotic signaling cascade followed by mitochondrial cytochrome c release and activation of caspase-3 (see Ahmed et al., and references therein). Additionally, several studies suggest that galectin-3 promotes tumor angiogenesis and metastasis in many cancers. Disruption of galectin-3 expression could impair tumoral angiogenesis by reducing VEGF secretion from TGFβ1-induced TAMs (Machado et al., Cancer Med. 2014 April; 3(2): 201-14. Galectin-3 disruption impaired tumoral angiogenesis by reducing VEGF secretion from TGFβ1-induced macrophages). Galectin-1 prolongs cell-surface retention of VEGF receptor 2 (VEGFR2) and stimulates VEGF-independent tumor angiogenesis.

In certain embodiments, the genetically engineered bacteria produce one or more anti-cancer molecules that inhibit Galectin-3 and/or Galectin-1. In some embodiments, the genetically engineered bacterium is a tumor-targeting bacterium that expresses an anti-Galectin-3 antibody and/or an anti-Galectin-1 antibody, e.g., a single chain antibody. In some embodiments, the genetically engineered bacterium expresses an anti-Galectin-3 antibody and/or an anti-Galectin-1 antibody, e.g., single chain antibody, under the control of a promoter that is activated by low-oxygen conditions. In some embodiments, the genetically engineered bacterium is a tumor-targeting bacterium that expresses an anti-Galectin-3 antibody and/or an anti-Galectin-1 antibody, e.g., a single chain antibody, under the control of a promoter that is activated by low-oxygen conditions. In certain embodiments, the genetically engineered bacteria express an anti-Galectin-3 antibody and/or an anti-Galectin-1 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-Galectin-3 antibody and/or an anti-Galectin-1 antibody, e.g., single chain antibody, under the control of a cancer-specific promoter, a tissue-specific promoter, or a constitutive promoter, such as any of the promoters described herein.

TIE-1 and TIE-2 comprise the cell-surface receptors that bind and are activated by the angiopoietins, Ang1, Ang2, Ang3, and Ang4. The angiopoietins are protein growth factors required for the formation of blood vessels (angiogenesis). Ang1 and Ang4 function as agonistic or activating ligands for Tie2, whereas Ang2 and Ang3 behave as competitive antagonists. TIE2-expressing monocytes/macrophages (TEMs) are a highly-angiogenic and immune-suppressive tumor infiltrating macrophage subpopulation that expresses the angiopoietin receptor TIE2 and are often in juxtaposition to blood vessels through endothelial cell expression of the TIE2 ligand ANG2 (TIE2 can either bind ANG1 to resulting in vessel stabilization, or TIE2, opposing stabilization). The immunosuppressive effect of TEMs results from their ability to secrete IL-10, which inhibits T cell activation and stimulates the expansion of Tregs.

In certain embodiments, the genetically engineered bacteria produce one or more anti-cancer molecules that inhibit Tie-2. In some embodiments, the genetically engineered bacterium is a tumor-targeting bacterium that expresses an anti-Tie-2 antibody and/or an anti-Ang1 antibody and/or an anti-Ang4 antibody, e.g., a single chain antibody. In some embodiments, the genetically engineered bacterium expresses an anti-Tie-2 antibody and/or an anti-Ang1 antibody and/or an anti-Ang4 antibody, e.g., single chain antibody, under the control of a promoter that is activated by low-oxygen conditions. In some embodiments, the genetically engineered bacterium is a tumor-targeting bacterium that expresses an anti-Tie-2 antibody, and/or an anti-Ang1 antibody and/or an anti-Ang4 antibody, e.g., a single chain antibody, under the control of a promoter that is activated by low-oxygen conditions. In certain embodiments, the genetically engineered bacteria express an anti-Tie-2 antibody and/or an anti-Ang1 antibody and/or an anti-Ang4 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-Tie-2 antibody and/or an anti-Ang1 antibody and/or an anti-Ang4 antibody, e.g., single chain antibody, under the control of a cancer-specific promoter, a tissue-specific promoter, or a constitutive promoter, such as any of the promoters described herein.

VEGFR-2 appears to be the most important receptor in VEGF-induced mutagenesis and permeability. Receptor activation during angiogenesis induces the production of platelet-activating factor (PAF) by endothelial cells, stimulates their mitosis and migration, and increases vascular permeability. PAF promotes the expression of potent angiogenic factors and chemokines, including acid fibroblast factor, basic fibroblast growth factor (bFGF), and macrophage inflammatory protein 2 (Hoeben et al., Pharmacological Reviews vol. 56 no. 4 549-580; Vascular Endothelial Growth Factor and Angiogenesis.

In certain embodiments, the genetically engineered bacteria produce one or more anti-cancer molecules that inhibit VEGFR-2. In some embodiments, the genetically engineered bacterium is a tumor-targeting bacterium that expresses an anti-VEGFR-2 antibody, e.g., a single chain antibody. In some embodiments, the genetically engineered bacterium expresses an anti-VEGFR-2 antibody, e.g., single chain antibody, under the control of a promoter that is activated by low-oxygen conditions. In some embodiments, the genetically engineered bacterium is a tumor-targeting bacterium that expresses an anti-VEGFR-2 antibody, e.g., a single chain antibody, under the control of a promoter that is activated by low-oxygen conditions. In certain embodiments, the genetically engineered bacteria express an anti-VEGFR-2 antibody, e.g., single chain antibody, under the control of a promoter that is activated by hypoxic conditions, or by inflammatory conditions, such as any of the promoters activated by said conditions and described herein. In some embodiments, the genetically engineered bacteria expresses an anti-VEGFR-2 antibody, e.g., single chain antibody, under the control of a cancer-specific promoter, a tissue-specific promoter, or a constitutive promoter, such as any of the promoters described herein.

Stromal Modulation

In many cases, the tumor microenvironment, or stroma, occupies the majority of the tumor mass. The tumor microenvironment, or stroma, consists of a dynamic assortment of extracellular matrix components and non-neoplastic cells, including fibroblastic, vascular, and immune cells, which composition often changes at various stages of disease development. For example, some stroma can be very heterogeneous and comprise cellular and acellular components, including for example fibroblasts, myofibroblasts, stellate cells, immune cells, blood vessels, extracellular matrix (e.g., collagen, fibronectin, proteoglycans, and hyaluronic acid, catalytically active enzymes, proteinases), and soluble proteins such as cytokines and growth factors. The diverse influences exerted by the stroma on cancer cells, and the complex "cross-talk" between cells in the stroma (cell: cell and cell: matrix interactions), has a significant impact on the success or failure of treatment. In many cases, the stroma supports local invasion, tumor growth, promotes distal metastasis, results in higher tumor grade, and simultaneously serves as a physical barrier to drug delivery, thus resulting in poorer overall survival. Thus, molecules and methods that alter the stromal composition or function (e.g., enzymatic remodeling of the tumor stroma) may play an important role in treatment strategies. For example, pancreatic ductal adenocarcinoma (PDA) is one of the most stroma-rich cancers and it is common for stromal components to outnumber cancer cells.

The accumulation of extracellular matrix (ECM) components can distort the normal architecture of tumor and stromal tissue, causing an abnormal configuration of blood and lymphatic vessels. One factor that may contribute to the therapeutic resistance of a tumor is the rigidity of the ECM that significantly compresses blood vessels, resulting in reduced perfusion (due to constraints on diffusion and convection) that ultimately impedes the delivery of therapeutics to tumor cells. One strategy to reduce vessel compression in the stroma and assist in drug delivery is to enzymatically break down the ECM scaffold, which in some stromal tumor environments consist of fibroblasts, immune cells, and endothelial cells imbedded within a dense and complex ECM with abundant Hyaluronan or Hyaluronic acid (HA). HA is a large linear glycosaminoglycan (GAG) composed of repeating N-acetyl glucosamine and glucuronic acid units that retains water due to its high colloid osmotic pressure. HA plays a prominent role in maintaining the architecture, integrity, and malleability of tissues, particularly during dynamic processes such as embryogenesis and oncogenesis. HA is believed to play a role in tumor stroma formation. The retention of water in HA provides elasticity to connective tissue in healthy organs, but raises interstitial fluid pressure and compresses blood vessels when it accumulates to excess, as it does in many solid tumors, such as PDA, tumors of the prostate, colon, breast, stomach, ovary, and pancreas. For example, the interstitial fluid pressure in PDA has been observed to be 75-130 mmHg as compared with normal arteriolar and capillary pressures of 40-80 mmHg and 15-40 mmHg, respectively. It is thought that HA maintains rigidity by contributing to the tethering of collagen fibers under tension.

Enzymatic HA degradation by hyaluronidase (PEGPH2O; rHuPH20) has been shown to decrease interstitial fluid pressure in mouse pancreatic ductal adenocarcinoma (PDA) tumors with a concomitant observation in vessel patency, drug delivery, and survival (Provenzano et al. Cancer Cell, 2012, 21:418-429; Thompson et al., Mol Cancer Ther, 2010, 9:3052-64). It is believed that PEGPH2O liberates water bound to HA by cleaving the extended polymer into substituent units. The release of trapped water decreases the interstitial fluid pressure to a range of 20-30 mmHg, enabling collapsed arterioles and capillaries to open (Provenzano et al.).

In some embodiments, the engineered bacteria comprise gene sequence encoding one or more molecules that modulate the stroma. In some embodiments, the engineered bacteria comprise gene sequence encoding one or more copies of an enzyme that degrades Hyaluronan or Hyaluronic acid (HA). In some embodiments, the engineered bacteria comprise gene sequence encoding one or more copies of hyaluronidase.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more hyaluronidase than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more hyaluronidase than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more hyaluronidase than unmodified bacteria of the same bacterial subtype under the same conditions.

In any of these embodiments, the bacteria genetically engineered to produce hyaluronidase degrade 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more hyaluronan than unmodified bacteria of the same bacterial subtype under the same conditions.

In yet another embodiment, the genetically engineered bacteria degrade 1.0-1.2-fold, 1.2-1.4-fold, 1.4-1.6-fold, 1.6-1.8-fold, 1.8-2-fold, or two-fold more hyaluronan than unmodified bacteria of the same bacterial subtype under the same conditions. In yet another embodiment, the genetically engineered bacteria degrade three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more hyaluronan than unmodified bacteria of the same bacterial subtype under the same conditions. In one embodiment, the genetically engineered bacteria comprising one or more genes encoding hyaluronidase for secretion are capable of degrading hyaluronan to about the same extent as recombinant hyaluronidase at the same concentrations under the same conditions.

In some embodiments, the bacteria genetically engineered to secrete hyaluronidase are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete hyaluronidase are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete hyaluronidase are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce hyaluronidase are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce hyaluronidase are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce hyaluronidase are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria comprise hyaluronidase gene sequence(s) encoding one or more polypeptide(s) selected from SEQ ID NO: 1127, SEQ ID NO: 1128, SEQ ID NO:1129, SEQ ID NO: 1130, SEQ ID NO: 1131 or functional fragments thereof. In some embodiments, genetically engineered bacteria comprise a gene sequence encoding a polypeptide that is at least about 80%, at least about 85%, at least about 90%, at least about 95%, or at least about 99% identity to one or more polypeptide(s) selected from selected from SEQ ID NO: 1127, SEQ ID NO: 1128, SEQ ID NO:1129, SEQ ID NO: 1130, SEQ ID NO: 1131 or a functional fragment thereof. In some specific embodiments, the polypeptide comprises one or more polypeptide(s) selected form selected from SEQ ID NO: 1127, SEQ ID NO: 1128, SEQ ID NO:1129, SEQ ID NO: 1130, SEQ ID NO: 1131. In other specific embodiments, the polypeptide consists of one or more polypeptide(s) of selected from selected from SEQ ID NO: 1127, SEQ ID NO: 1128, SEQ ID NO:1129, SEQ ID NO: 1130, SEQ ID NO: 1131. In certain embodiments, the hyaluronidase sequence has at least about 80%, 85%, 86%, 87%, 88%, 89%, 90%, 91%, 92%, 93%, 94%, 95%, 96%, 97%, 98%, or 99% identity with one or more polynucleotides selected from SEQ ID NO: 1122, SEQ ID NO: 1123, SEQ ID NO: 1224, SEQ ID NO: 1225, SEQ ID NO: 1226 or a functional fragment thereof. In some specific embodiments, the gene sequence comprises one or more sequences selected from SEQ ID NO: 1127, SEQ ID NO: 1128, SEQ ID NO:1129, SEQ ID NO: 1130, SEQ ID NO: 1131. In other specific embodiments, the gene sequence consists of one or more polynucleotides selected from SEQ ID NO: 1127, SEQ ID NO: 1128, SEQ ID NO:1129, SEQ ID NO: 1130, SEQ ID NO: 1131.

In some embodiments, the engineered bacteria comprise gene sequence encoding one or more copies of human hyaluronidase. In some embodiments, the hyaluronidase is leech hyaluronidase. In any of these embodiments, the gene sequences comprising the hyaluronidase further encode a secretion tag selected from PhoA, OmpF, cvaC, TorA, FdnG, DmsA, and PelB. In some embodiments, the secretion tag is at the N terminus of the hyaluronidase polypeptide sequence and at the 5' end of the hyaluronidase coding sequence. In some embodiments, the secretion tag is at the C terminus of the hyaluronidase polypeptide sequence and at the 3' end of the hyaluronidase coding sequence. In one embodiment, the secretion tag is PhoA. In some embodiments, the genetically engineered bacteria encode hyaluronidase for secretion. In some embodiments, the genetically engineered bacteria encode hyaluronidase for display on the bacterial cell surface. In some embodiments, the genetically engineered bacteria further comprise one or more deletions in an outer membrane protein selected from lpp, nlP, tolA, and PAL. In some embodiments, the deleted or mutated outer membrane protein is PAL.

In some embodiments, the genetically engineered microorganisms are capable of expressing any one or more of the described stromal modulation circuits or gene sequences, e.g., hyaluronidase circuits, in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding stromal modulation circuits, e.g., hyaluronidase circuits, are controlled by a promoter inducible by such conditions and/or inducers in vivo and/or in vitro. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described stromal modulation gene sequences, e.g., hyaluronidase gene sequences, are present on one or more plasmids (e.g., high copy or low copy) or are integrated into one or more sites in the microorganismal chromosome. Also, in some embodiments, the genetically engineered microorganisms are further capable of expressing any one or more of the described stromal modulation, e.g., hyaluronidase circuits, and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In any of these embodiments, the genetically engineered bacteria further comprise gene sequence(s) for the consumption of adenosine. In some embodiments, the gene sequence(s) for the consumption of adenosine comprise one or more genes selected from add, xapA, deoD, xdhA, xdhB, and xdhC. In some embodiments, the gene sequence(s) for the consumption of adenosine encode a transporter for importing adenosine. In some embodiments, the gene sequence(s) encoding a transporter comprise nupC. In some embodiments, the gene sequence(s) encoding a transporter comprise nupG. In some embodiments, the genetically engineered bacteria further comprise gene sequence(s) encoding anti-CD40 antibody. In some embodiment, the anti-CD40 antibody is an scFv. In some embodiments, the anti-CD40 antibody is secreted. In some embodiments, the anti-CD40 antibody is displayed on the cell surface.

Activation of an Innate Immune Response

Lytic Peptides

The bacteria of the present disclosure, by themselves, will result in cell lysis at the tumor site due to the presence of PAMPs and DAMPs, which will initiate an innate immune response. In addition, some bacteria have the added feature of being lytic microorganisms with the ability to lyse tumor cells. Thus, in some embodiments, the engineered microorganisms, produce natural or native lytic peptides. In some embodiments, the bacteria can be further engineered to produce one or more cytotoxic molecules, e.g., lytic peptides that have the ability to lyse cancer or tumor cells locally in the tumor microenvironment upon delivery to the tumor site. Upon cell lysis, the tumor cells release tumor-associated antigens that serve to promote an adaptive immune response. The presence of PAMPs and DAMPs promote the maturation of antigen-presenting cells, such as dendritic cells, which activate antigen-specific CD4+ and CD8+ T cell responses. Thus, not only does the delivery of a lytic peptide to the tumor site serve to kill the tumor cell locally, it also exposes tumor associated antigens and neoantigens to antigen presenting cells, leading to immune-mediated antitumor responses. Such neo-antigens can be taken up by local APCs in the context of a pro-inflammatory environment, which can trigger an immune response against the neo-antigen, killing the antigen-expressing cancer cells, including distant cancer cells not exposed to the bacteria or virus. Exemplary lytic peptide are described in International Patent Application PCT/US2017/013072, the contents of which is herein incorporated by reference in its entirety.

Thus, in some embodiments, the genetically engineered bacteria or genetically engineered viruses are capable of producing one or more cytotoxin(s). In some embodiments, the genetically engineered bacteria or genetically engineered viruses are capable of producing one or more lytic peptide molecule(s), such as any of the cytotoxins and lytic peptides provided herein. In certain embodiments, the genetically engineered bacteria produce one or more cytotoxins and/or lytic peptides, e.g. one or more of the peptides provided herein. In some embodiments, the genetically engineered bacterium is a tumor-targeting bacterium that expresses one or more cytotoxins and/or lytic peptides. In some embodiments, the genetically engineered bacterium expresses one or more cytotoxins and/or one or more lytic peptides, under the control of a promoter that is activated by low-oxygen conditions. In some embodiments, the genetically engineered bacterium is a tumor-targeting bacterium that expresses one or more cytotoxins and/or one or more lytic peptides under the control of a promoter that is activated by low-oxygen conditions. In some embodiments, the genetically engineered bacterium expresses one or more cytotoxins and/or one or more lytic peptides, under the control of a promoter that is activated by hypoxic conditions, or by inflammatory conditions, such as any of the promoters activated by said conditions and described herein. In some embodiments, the genetically engineered bacteria expresses one or more cytotoxins and/or one or more lytic peptides, under the control of a cancer-specific promoter, a tissue-specific promoter, or a constitutive promoter, such as any of the promoters described herein.

In some embodiments, the genetically engineered bacteria encode a the lytic or toxic peptide. In some embodiments, the polypeptide has at least about 80% identity with a sequence selected from one or more of SEQ ID NO: 104-107 and SEQ ID NO: 126-151. In another embodiment, the lytic or toxic peptide has at least about 85% identity with a sequence selected from one or more of SEQ ID NO: 104-107 and SEQ ID NO: 126-151. In one embodiment, the lytic or toxic peptide has at least about 90% identity with a sequence selected from one or more of SEQ ID NO: 104-107 and SEQ ID NO: 126-151. In one embodiment, the lytic or toxic peptide has at least about 95% identity with a sequence selected from one or more of SEQ ID NO: 104-107 and SEQ ID NO: 126-151. In another embodiment, the lytic or toxic peptide has at least about 96%, 97%, 98%, or 99% identity with a sequence selected from one or more of SEQ ID NO: 104-107 and SEQ ID NO: 126-151. Accordingly, in one embodiment, the lytic or toxic peptide has at least about 80%, 81%, 82%, 83%, 84%, 85%, 86%, 87%, 88%, 89%, 90%, 91%, 92%, 93%, 94%, 95%, 96%, 97%, 98%, or 99% identity with a sequence selected from one or more of SEQ ID NO: 104-107 and SEQ ID NO: 126-151. In another embodiment, the lytic or toxic peptide comprises a sequence selected from one or more of SEQ ID NO: 104-107 and SEQ ID NO: 126-151. In yet another embodiment, the lytic or toxic peptide gene consists of a sequence selected from one or more of SEQ ID NO: 104-107 and SEQ ID NO: 126-151.

STING Agonists

Stimulator of interferon genes (STING), also known as transmembrane protein 173 (TMEM173), mediator of interferon regulatory factor 3 activation (MITA), MPYS or endoplasmic reticulum interferon stimulator (ERIS), is a dimeric protein which is mainly expressed in macrophages, T cells, dendritic cells, endothelial cells, and certain fibroblasts and epithelial cells. STING plays an important role in the innate immune response—mice lacking STING are viable though prone to lethal infection following exposure to a variety of microbes. STING functions as a cytosolic receptor for the second messengers in the form of cytosolic cyclic dinucleotides (CDNs). Upon stimulation by the CDN, STING activates TBK1/IRF3 (interferon regulatory factor 3), NF-κB, and STAT6 signal transduction pathways, and thereby promoting type I interferon and proinflammatory cytokine responses. CDNs include canonical cyclic di-GMP (c[G(30-50)pG(30-50)p] or cyclic di-AMP or cyclic GAMP (cGMP-AMP) (Barber, STING-dependent cytosolic DNA sensing pathways; Trends Immunol. 2014 February; 35(2): 88-93).

CDNs can be exogenously (i.e., bacterially) and/or endogenously produced (i.e., within the host by a host enzyme upon exposure to dsDNA). STING is able to recognize various bacterially produced CDNs, which triggers innate immune signaling response (Ma et al., The cGAS-STING Defense Pathway and Its Counteraction by Viruses; Cell Host & Microbe 19, Feb. 10, 2016). Additionally, STING binds to CDNs produced by cGAS, an interferon inducible protein which can generate cyclic GMP-AMP or cGAMP (Cai et al., The cGAS-cGAMP-STING Pathway of Cytosolic DNA Sensing and Signaling; Molecular Cell 54, Apr. 24, 2014). cGAS interacts with dsDNA and utilizes GTP and ATP to generate cGAMP capable of STING activation. In contrast to prokaryotic CDNs, which have two canonical 30-50 phosphodiester linkages, the human cGAS product contains a unique 20-50 bond resulting in a mixed linkage cyclic GMP-AMP molecule, denoted as 2',3' cGAMP (as described in (Kranzusch et al., Ancient Origin of cGAS-STING Reveals Mechanism of Universal 2',3' cGAMP Signaling; Molecular Cell 59, 891-903, Sep. 17, 2015 and references therein). The bacterium *Vibrio cholerae* encodes an enzyme called DncV that is a structural homolog of cGAS and synthesizes a related second messenger with canonical 3'-5' bonds (3',3' cGAMP).

Components of the stimulator of interferon genes (STING) pathway plays an important role in the detection of tumor cells by the immune system. In preclinical studies, cyclic dinucleotides (CDN), naturally occurring or rationally designed synthetic derivatives, are able to promote an aggressive antitumor response. For example, when co-formulated with an irradiated GM-CSF-secreting whole-cell vaccine in the form of STINGVAX, synthetic CDNs increased the antitumor efficacy and STINGVAX combined with PD-1 blockade induced regression of established tumors (Fu et al., STING agonist formulated cancer vaccines can cure established tumors resistant to PD-1 blockade; Sci Transl Med. 2015 Apr. 15; 7(283): 283ra52). In another example, Smith et al. conducted a study showing that STING agonists may augment CAR T therapy by stimulating the immune response to eliminate tumor cells that are not recognized by the adoptively transferred lymphocytes and thereby improve the effectiveness of CAR T cell therapy (Smith et al., Biopolymers co-delivering engineered T cells and STING agonists can eliminate heterogeneous tumors; J Clin Invest. 2017 Jun. 1; 127(6):2176-2191).

In some embodiments, the genetically engineered bacterium is a tumor-targeting bacterium which is capable of producing one or more STING agonists. Non limiting examples of STING agonists which can be produced by the genetically engineered bacteria of the disclosure include 2'2'-cGAMP, 2'2'-cGAMP VacciGrade™ (Cyclic [G(2',5') pA(2',5')p]), 2'3'-cGAMP, 2'3'-cGAMP VacciGrade™ (Cyclic [G(2',5')pA(3',5')p]), 2'3'-cGAM(PS)2 (Rp/Sp), 3'3'-cGAMP, 3'3'-cGAMP VacciGrade™ (Cyclic [G(3',5')pA(3', 5')p]), c-di-AMP, c-di-AMP VacciGrade™ (Cyclic diadenylate monophosphate Th1/Th2 response), 2'3'-c-di-AMP, 2'3'-c-di-AM(PS)2 (Rp,Rp) (Bisphosphorothioate analog of c-di-AMP, Rp isomers), 2'3'-c-di-AM(PS)2 (Rp, Rp) VacciGrade™, c-di-GMP, c-di-GMP VacciGrade™, 2'3'-c-di-GMP, and c-di-IMP. In some embodiments, the genetically engineered bacterium is a tumor-targeting bacterium that comprises a gene encoding one or more enzymes for the production of one or more STING agonists.

Cyclic-di-GAMP synthase (cdi-GAMP synthase or cGAS) produces the cyclic-di-GAMP from one ATP and one GTP. In some embodiments, the enzymes are c-di-GAMP synthases (cGAS). In one embodiment, the genetically engineered bacteria comprise one or more gene sequences for the expression of an enzyme in class EC 2.7.7.86. In some embodiments, such enzymes are bacterial enzymes. In some embodiments, the enzyme is a bacterial c-di-GMP synthase. In one embodiment, the bacterial c-di-GAMP synthase is from *Vibrio cholerae*. In some embodiments, the enzymes are mammalian enzymes. In one embodiment, the genetically engineered bacteria comprise a gene encoding the human polypeptide cGAS.

Diadenylate cyclase produces one molecule cyclic-di-AMP from two ATP molecules. In one embodiment, the genetically engineered bacteria comprise one or more gene sequences for the expression of a diadenylate cyclase. In one embodiment, the genetically engineered bacteria comprise one or more gene sequences for the expression of an enzyme in class EC 2.7.7.85. In one embodiment, the diadenylate cyclase is a bacterial diadenylate cyclase. In one embodiment, the diadenylate cyclase is DacA. In one embodiment, the DacA is from *Listeria monocytogenes*.

Other suitable diadenylate cyclases are known in the art and include those include in the EggNog database (http://eggnogdb.embl.de). Non-limiting examples of diadenylate cyclases which can be expressed by the bacteria include *Megasphaera* sp. UPII 135-E (HMPREF1040_0026), *Streptococcus anginosus* SK52=DSM 20563 (HMPREF9966_0555), *Streptococcus mitis* by. 2 str. SK95 (HMPREF9965_1675), *Streptococcus infantis* SK1076 (HMPREF9967_1568), *Acetonema longum* DSM 6540 (ALO_03356), *Sporosarcina newyorkensis* 2681 (HMPREF9372_2277), *Listeria monocytogenes* str. Scott A (BN418_2551), *Candidatus arthromitus* sp. SFB-mouse-Japan (SFBM_1354), *Haloplasma contractile* SSD-17B 2 seqs HLPCO_01750, HLPCO_08849), *Lactobacillus kefiranofaciens* ZW3 (WANG_0941), *Mycoplasma anatis* 1340 (GIG_03148), *Streptococcus constellatus* subsp. *pharyngis* SK1060=CCUG 46377 (HMPREF1042_1168), *Streptococcus infantis* SK970 (HMPREF9954_1628), *Paenibacillus mucilaginosus* KNP414 (YBBP), *Nostoc* sp. PCC 7120 (ALL2996), *Mycoplasma columbinum* SF7 (MCSF7_01321), *Lactobacillus ruminis* SPM0211 (LRU_01199), *Candidatus arthromitus* sp. SFB-rat-Yit (RATSFB_1182), *Clostridium* sp. SY8519 (CXIVA_02190), *Brevibacillus laterosporus* LMG 15441 (BRLA_CO2240), *Weissella koreensis* KACC 15510 (WKK_01955), *Brachyspira intermedia* PWS/A (BINT_2204), *Bizionia argentinensis* JUB59 (BZARG_2617), *Streptococcus salivarius* 57.1 (SSAL_01348), *Alicyclobacillus acidocaldarius* subsp. *acidocaldarius* Tc-4-1 (TC41_3001), *Sulfobacillus acidophilus* TPY (TPY_0875), *Streptococcus pseudopneumoniae* IS7493 (SPPN_07660), *Megasphaera elsdenii* DSM 20460 (MELS_0883), *Streptococcus infantarius* subsp. *infantarius* CJ18 (SINF_1263), *Blattabacterium* sp. (*Mastotermes darwiniensis*) str. MADAR (MADAR_511), *Blattabacterium* sp. (*Cryptocercus punctulatus*) str. Cpu (BLBCPU_093), *Synechococcus* sp. CC9605 (SYNCC9605_1630), *Thermus* sp. CCB_US3_UF1 (AEV17224.1), *Mycoplasma haemocanis* str. Illinois (MHC_04355), *Streptococcus macedonicus* ACA-DC 198 (YBBP), *Mycoplasma hyorhinis* GDL-1 (MYM_0457), *Synechococcus elongatus* PCC 7942 (SYNPCC7942_0263), *Synechocystis* sp. PCC 6803 (SLL0505), *Chlamydophila pneumoniae* CWL029 (YBBP), *Microcoleus chthonoplastes* PCC 7420 (MC7420_6818), *Persephonella marina* EX-H1 (PERMA_1676), *Desulfitobacterium hafniense* Y51 (DSY4489), *Prochlorococcus marinus* str. AS9601 (A9601_11971), *Flavobacteria bacterium* BBFL7 (BBFL7_02553), *Sphaerochaeta globus* str. Buddy (SPIBUDDY_2293), *Sphaerochaeta pleomorpha* str. Grapes (SPIGRAPES_2501), *Staphylococcus aureus* subsp. *aureus* Mu50 (SAV2163), *Streptococcus pyogenes* M1 GAS (SPY_1036), *Synechococcus* sp. WH 8109 (SH8109_2193), *Prochlorococcus marinus* subsp. *marinus* str. CCMP1375 (PRO_1104), *Prochlorococcus marinus* str. MIT 9515 (P9515_11821), *Prochlorococcus marinus* str. MIT 9301 (P9301_11981), *Prochlorococcus marinus* str. NATL1A (NATL1_14891), *Listeria monocytogenes* EGD-e (LMO2120), *Streptococcus pneumoniae* TIGR4 2 seqs SPNET_02000368, SP_1561), *Streptococcus pneumoniae* R6 (SPR1419), *Staphylococcus epidermidis* RP62A (SERP1764), *Staphylococcus epidermidis* ATCC 12228 (SE_1754), *Desulfobacterium autotrophicum* HRM2 (HRM2_32880), *Desulfotalea psychrophila* LSv54 (DP1639), *Cyanobium* sp. PCC 7001 (CPCC7001_1029), *Chlamydophila pneumoniae* TW-183 (YBBP), *Leptospira interrogans* serovar Lai str. 56601 (LA_3304), *Clostridium perfringens* ATCC 13124 (CPF_2660), *Thermosynechococ-* cus elongatus BP-1 (TLR1762), Bacillus anthracis str. Ames (BA_0155), Clostridium thermocellum ATCC 27405 (CTHE_1166), Leuconostoc mesenteroides subsp. mesenteroides ATCC 8293 (LEUM_1568), Oenococcus oeni PSU-1 (OEOE_1656), Trichodesmium erythraeum IMS101 (TERY_2433), Tannerella forsythia ATCC 43037 (BFO_1347), Sulfurihydrogenibium azorense Az-Fu1 (SULAZ_1626), Candidatus koribacter versatilis Ellin345 (ACID345_0278), Desulfovibrio alaskensis G20 (DDE_1515), Carnobacterium sp. 17-4 (YBBP), Streptococcus mutans UA159 (SMU_1428C), Mycoplasma agalactiae (MAG3060), Streptococcus agalactiae NEM316 (GBS0902), Clostridium tetani E88 (CTC_02549), Ruminococcus champanellensis 18P13 (RUM_14470), Croceibacter atlanticus HTCC2559 (CA2559_13513), Streptococcus uberis 0140J (SUB1092), Chlamydophila abortus S26/3 (CAB642), Lactobacillus plantarum WCFS1 (LP_0818), Oceanobacillus iheyensis HTE831 (OB0230), Synechococcus sp. RS9916 (RS9916_31367), Synechococcus sp. RS9917 (RS9917_00967), Bacillus subtilis subsp. subtilis str. 168 (YBBP), Aquifex aeolicus VF5 (AQ_1467), Borrelia burgdorferi B31 (BB_0008), Enterococcus faecalis V583 (EF_2157), Bacteroides thetaiotaomicron VPI-5482 (BT_3647), Bacillus cereus ATCC 14579 (BC_0186), Chlamydophila caviae GPIC (CCA_00671), Synechococcus sp. CB0101 (SCB01_010100000902), Synechococcus sp. CB0205 (SCB02_010100012692), Candidatus solibacter usitatus Ellin6076 (ACID_1909), Geobacillus kaustophilus HTA426 (GK0152), Verrucomicrobium spinosum DSM 4136 (VSPID_010100022530), Anabaena variabilis ATCC 29413 (AVA_0913), Porphyromonas gingivalis W83 (PG_1588), Chlamydia muridarum Nigg (TC_0280), Deinococcus radiodurans R1 (DR_0007), Geobacter sulfurreducens PCA 2 seqs GSU1807, GSU0868), Mycoplasma arthritidis 158L3-1 (MARTH_ORF527), Mycoplasma genitalium G37 (MG105), Treponema denticola ATCC 35405 (TDE_1909), Treponema pallidum subsp. pallidum str. Nichols (TP_0826), butyrate-producing bacterium SS3/4 (CK3_23050), Carboxydothermus hydrogenoformans Z-2901 (CHY_2015), Ruminococcus albus 8 (CUS_5386), Streptococcus mitis NCTC 12261 (SM12261_1151), Gloeobacter violaceus PCC 7421 (GLL0109), Lactobacillus johnsonii NCC 533 (LJ_0892), Exiguobacterium sibiricum 255-15 (EXIG_0138), Mycoplasma hyopneumoniae J (MHJ_0485), Mycoplasma synoviae 53 (MS53_0498), Thermus thermophilus HB27 (TT_C1660), Onion yellows phytoplasma OY-M (PAM_584), Streptococcus thermophilus LMG 18311 (OSSG), Candidatus protochlamydia amoebophila UWE25 (PC1633), Chlamydophila felis Fe/C-56 (CF0340), Bdellovibrio bacteriovorus HD100 (BD1929), Prevotella ruminicola 23 (PRU_2261), Moorella thermoacetica ATCC 39073 (MOTH_2248), Leptospira interrogans serovar Copenhageni str. Fiocruz L1-130 (LIC_10844), Mycoplasma mobile 163K (MMOB4550), Synechococcus elongatus PCC 6301 (SYC1250_C), Cytophaga hutchinsonii ATCC 33406 (CHU_3222), Geobacter metallireducens GS-15 2 seqs GMET_1888, GMET_1168), Bacillus halodurans C-125 (BH0265), Bacteroides fragilis NCTC 9343 (BF0397), Chlamydia trachomatis D/UW-3/CX (YBBP), Clostridium acetobutylicum ATCC 824 (CA_C3079), Clostridium difficile 630 (CD0110), Lactobacillus acidophilus NCFM (LBA0714), Lactococcus lactis subsp. lactis Il1403 (YEDA), Listeria innocua Clip11262 (LIN2225), Mycoplasma penetrans HF-2 (MYPE2120), Mycoplasma pulmonis UAB CTIP (MYPU_4070), Thermoanaerobacter tengcongensis MB4 (TTE2209), Pediococcus pentosaceus ATCC 25745 (PEPE_0475), Bacillus licheniformis DSM 13=ATCC 14580 2 seqs YBBP, BL02701), Staphylococcus haemolyticus JCSC1435 (SH0877), Desulfuromonas acetoxidans DSM 684 (DACE_0543), Thermodesulfovibrio yellowstonii DSM 11347 (THEYE_A0044), Mycoplasma bovis PG45 (MBOVPG45_0394), Anaeromyxobacter dehalogenans 2CP-C(ADEH_1497), Clostridium beijerinckii NCIMB 8052 (CBEI_0200), Borrelia garinii PBi (BG0008), Symbiobacterium thermophilum IAM 14863 (STH192), Alkaliphilus metalliredigens QYMF (AMET_4313), Thermus thermophilus HB8 (TTHA0323), Coprothermobacter proteolyticus DSM 5265 (COPRO5265_1086), Thermomicrobium roseum DSM 5159 (TRD_0688), Salinibacter ruber DSM 13855 (SRU_1946), Dokdonia donghaensis MED134 (MED134_03354), Polaribacter irgensii 23-P (P123P_01632), Psychroflexus torquis ATCC 700755 (P700755_02202), Robiginitalea biformata HTCC2501 (RB2501_10597), Polaribacter sp. MED152 (MED152_11519), Maribacter sp. HTCC2170 (FB2170_01652), Microscilla marina ATCC 23134 (M23134_07024), Lyngbya sp. PCC 8106 (L8106_18951), Nodularia spumigena CCY9414 (N9414_23393), Synechococcus sp. BL107 (BL107_11781), Bacillus sp. NRRL B-14911 (B14911_19485), Lentisphaera araneosa HTCC2155 (LNTAR_18800), Lactobacillus sakei subsp. sakei 23K (LCA_1359), Mariprofundus ferrooxydans PV-1 (SPV1_13417), Borrelia hermsii DAH (BH0008), Borrelia turicatae 91E135 (BT0008), Bacillus weihenstephanensis KBAB4 (BCERKBAB4_0149), Bacillus cytotoxicus NVH 391-98 (BCER98_0148), Bacillus pumilus SAFR-032 (YBBP), Geobacter sp. FRC-32 2 seqs GEOB_2309, GEOB_3421), Herpetosiphon aurantiacus DSM 785 (HAUR_3416), Synechococcus sp. RCC307 (SYNRCC307_0791), Synechococcus sp. CC9902 (SYNCC9902_1392), Deinococcus geothermalis DSM 11300 (DGEO_0135), Synechococcus sp. PCC 7002 (SYNPCC7002_A0098), Synechococcus sp. WH 7803 (SYNWH7803_1532), Pedosphaera parvula Ellin514 (CFLAV_PD5552), Synechococcus sp. JA-3-3Ab (CYA_2894), Synechococcus sp. JA-2-3Ba(2-13) (CYB_1645), Aster yellows witches-broom phytoplasma AYWB (AYWB_243), Paenibacillus sp. JDR-2 (PJDR2_5631), Chloroflexus aurantiacus J-10-fl (CAUR_1577), Lactobacillus gasseri ATCC 33323 (LGAS_1288), Bacillus amyloliquefaciens FZB42 (YBBP), Chloroflexus aggregans DSM 9485 (CAGG_2337), Acaryochloris marina MBIC11017 (AM1_0413), Blattabacterium sp. (Blattella germanica) str. Bge (BLBBGE_101), Simkania negevensis Z (YBBP), Chlamydophila pecorum E58 (G5S_1046), Chlamydophila psittaci 6BC 2 seqs CPSIT_0714, G5O_0707), Carnobacterium sp. AT7 (CAT7_06573), Finegoldia magna ATCC 29328 (FMG_1225), Syntrophomonas wolfei subsp. wolfei str. Goettingen (SWOL_2103), Syntrophobacter fumaroxidans MPOB (SFUM_3455), Pelobacter carbinolicus DSM 2380 (PCAR_0999), Pelobacter propionicus DSM 2379 2 seqs PPRO_2640, PPRO_2254), Thermoanaerobacter pseudethanolicus ATCC 33223 (TETH39_0457), Victivallis vadensis ATCC BAA-548 (VVAD_PD2437), Staphylococcus saprophyticus subsp. saprophyticus ATCC 15305 (SSP0722), Bacillus coagulans 36D1 (BCOA_1105), Mycoplasma hominis ATCC 23114 (MHO_0510), Lactobacillus reuteri 100-23 (LREU23DRAFT_3463), Desulfotomaculum reducens MI-1 (DRED_0292), Leuconostoc citreum KM20 (LCK_01297), Paenibacillus polymyxa E681 (PPE_04217), Akkermansia muciniphila ATCC BAA-835 (AMUC_0400), Alkaliphilus oremlandii OhILAs (CLOS_2417), Geobacter uraniireducens Rf4 2 seqs GURA_1367, GURA_2732), Caldicellulosiruptor saccharolyticus DSM 8903 (CSAC_1183), Pyramidobacter piscolens W5455 (HMPREF7215_0074), Leptospira borgpetersenii serovar Hardjo-bovis L550 (LBL_0913), Roseiflexus sp. RS-1 (ROSERS_1145), Clostridium phytofermentans ISDg (CPHY_3551), Brevibacillus brevis NBRC 100599 (BBR47_02670), Exiguobacterium sp. AT1b (EAT1B_1593), Lactobacillus salivarius UCC118 (LSL_1146), Lawsonia intracellularis PHE/MN1-00 (LI0190), Streptococcus mitis B6 (SMI_1552), Pelotomaculum thermopropionicum SI (PTH_0536), Streptococcus pneumoniae D39 (SPD_1392), Candidatus Phytoplasma mali (ATP_00312), Gemmatimonas aurantiaca T-27 (GAU_1394), Hydrogenobaculum sp. Y04AAS1 (HY04AAS1_0006), Roseiflexus castenholzii DSM 13941 (RCAS_3986), Listeria welshimeri serovar 6b str. SLCC5334 (LWE2139), Clostridium novyi NT (NT01CX_1162), Lactobacillus brevis ATCC 367 (LVIS_0684), Bacillus sp. B14905 (BB14905_08668), Algoriphagus sp. PR1 (ALPR1_16059), Streptococcus sanguinis SK36 (SSA_0802), Borrelia afzelii PKo 2 seqs BAPKO_0007, AEL69242.1), Lactobacillus delbrueckii subsp. bulgaricus ATCC 11842 (LDB0651), Streptococcus suis 05ZYH33 (SSU05_1470), Kordia algicida OT-1 (KAOT1_10521), Pedobacter sp. BAL39 (PBAL39_03944), Flavobacteriales bacterium ALC-1 (FBALC1_04077), Cyanothece sp. CCY0110 (CY0110_30633), Plesiocystis pacifica SIR-1 (PPSIR1_10140), Clostridium cellulolyticum H10 (CCEL_1201), Cyanothece sp. PCC 7425 (CYAN7425_4701), Staphylococcus carnosus subsp. carnosus TM300 (SCA_1665), Bacillus pseudofirmus OF4 (YBBP), Leeuwenhoekiella blandensis MED217 (MED217_04352), Geobacter lovleyi SZ 2 seqs GLOV_3055, GLOV_2524), Streptococcus equi subsp. zooepidemicus (SEZ_1213), Thermosinus carboxydivorans Nor1 (TCARDRAFT_1045), Geobacter bemidjiensis Bem (GBEM_0895), Anaeromyxobacter sp. Fw109-5 (ANAE109_2336), Lactobacillus helveticus DPC 4571 (LHV_0757), Bacillus sp. m3-β (BM3-1_010100010851), Gramella forsetii KT0803 (GFO_0428), Ruminococcus obeum ATCC 29174 (RUMOBE_03597), Ruminococcus torques ATCC 27756 (RUMTOR_00870), Dorea formicigenerans ATCC 27755 (DORFOR_00204), Dorea longicatena DSM 13814 (DORLON_01744), Eubacterium ventriosum ATCC 27560 (EUBVEN_01080), Desulfovibrio piger ATCC 29098 (DESPIG_01592), Parvimonas micra ATCC 33270 (PEPMIC_01312), Pseudoflavonifractor capillosus ATCC 29799 (BACCAP_01950), Clostridium scindens ATCC 35704 (CLOSCI_02389), Eubacterium hallii DSM 3353 (EUBHAL_01228), Ruminococcus gnavus ATCC 29149 (RUMGNA_03537), Subdoligranulum variabile DSM 15176 (SUBVAR_05177), Coprococcus eutactus ATCC 27759 (COPEUT_01499), Bacteroides ovatus ATCC 8483 (BACOVA_03480), Parabacteroides merdae ATCC 43184 (PARMER_03434), Faecalibacterium prausnitzii A2-165 (FAEPRAA2165_01954), Clostridium sp. L2-50 (CLOL250_00341), Anaerostipes caccae DSM 14662 (ANACAC_00219), Bacteroides caccae ATCC 43185 (BACCAC_03225), Clostridium bolteae ATCC BAA-613 (CLOBOL_04759), Borrelia duttonii Ly (BDU_14), Cyanothece sp. PCC 8801 (PCC8801_0127), Lactococcus lactis subsp. cremoris MG1363 (LLMG_0448), Geobacillus thermodenitrificans NG80-2 (GTNG_0149), Epulopiscium sp. N.t. morphotype B (EPULO_010100003839), Lactococcus garvieae Lg2 (LCGL_0304), Clostridium leptum DSM 753 (CLOLEP_03097), Clostridium spiroforme DSM 1552 (CLOSPI_01608), Eubacterium dolichum DSM 3991 (EUBDOL_00188), Clostridium kluyveri DSM 555 (CKL_0313), Porphyromonas gingivalis ATCC 33277 (PGN_0523), Bacteroides vulgatus ATCC 8482 (BVU_0518), Parabacteroides distasonis ATCC 8503 (BDI_3368), Staphylococcus hominis subsp. hominis C80 (HMPREF0798_01968), Staphylococcus caprae C87 (HMPREF0786_02373), Streptococcus sp. C150 (HMPREF0848_00423), Sulfurihydrogenibium sp. YO3AOP1 (SYO3AOP1_0110), Desulfatibacillum alkenivorans AK-01 (DALK_0397), Bacillus selenitireducens MLS10 (BSEL_0372), Cyanothece sp. ATCC 51142 (CCE_1350), Lactobacillus jensenii 1153 (LBJG_01645), Acholeplasma laidlawii PG-8A (ACL_1368), Bacillus coahuilensis m4-4 (BCOAM_010100001120), Geobacter sp. M18 2 seqs GM18_0792, GM18_2516), Lysinibacillus sphaericus C3-41 (BSPH_4568), Clostridium botulinum NCTC 2916 (CBN_3506), *Clostridium botulinum* C str. Eklund (CBC_A1575), *Alistipes putredinis* DSM 17216 (ALIPUT_00190), *Anaerofustis stercorihominis* DSM 17244 (ANASTE_01539), *Anaerotruncus colihominis* DSM 17241 (ANACOL_02706), *Clostridium bartlettii* DSM 16795 (CLOBAR_00759), *Clostridium ramosum* DSM 1402 (CLORAM_01482), *Borrelia valaisiana* VS116 (BVAVS116_0007), *Sorangium cellulosum* So ce 56 (SCE7623), *Microcystis aeruginosa* NIES-843 (MAE_25390), *Bacteroides stercoris* ATCC 43183 (BACSTE_02634), *Candidatus Amoebophilus asiaticus* 5a2 (AASI_0652), *Leptospira biflexa* serovar Patoc strain Patoc 1 (Paris) (LEPBU0735), *Clostridium* sp. 7_2_43FAA (CSBG_00101), *Desulfovibrio* sp. 3_1_syn3 (HMPREF0326_02254), *Ruminococcus* sp. 5_1_39BFAA (RSAG_02135), *Clostridiales bacterium* 1_7_47FAA (CBFG_00347), *Bacteroides fragilis* 3_1_12 (BFAG_02578), *Natranaerobius thermophilus* JW/NM-WN-LF (NTHER_0240), *Macrococcus caseolyticus* JCSC5402 (MCCL_0321), *Streptococcus gordonii* str. Challis substr. CH1 (SGO_0887), *Dethiosulfovibrio peptidovorans* DSM 11002 (DPEP_2062), *Coprobacillus* sp. 29_1 (HMPREF9488_03448), *Bacteroides coprocola* DSM 17136 (BACCOP_03665), *Coprococcus comes* ATCC 27758 (COPCOM_02178), *Geobacillus* sp. WCH70 (GWCH70_0156), uncultured Termite group 1 bacterium phylotype Rs-D17 (TGRD_209), *Dyadobacter fermentans* DSM 18053 (DFER_0224), *Bacteroides intestinalis* DSM 17393 (BACINT_00700), *Ruminococcus lactaris* ATCC 29176 (RUMLAC_01257), *Blautia hydrogenotrophica* DSM 10507 (RUMHYD_01218), *Candidatus* Desulforudis audaxviator MP104C (DAUD_1932), *Marvinbryantia formatexigens* DSM 14469 (BRYFOR_07410), *Sphaerobacter thermophilus* DSM 20745 (STHE_1601), *Veillonella parvula* DSM 2008 (VPAR_0292), *Methylacidiphilum infernorum* V4 (MINF_1897), *Paenibacillus* sp. Y412MC10 (GYMC10_5701), *Bacteroides finegoldii* DSM 17565 (BACFIN_07732), *Bacteroides eggerthii* DSM 20697 (BACEGG_03561), *Bacteroides pectinophilus* ATCC 43243 (BACPEC_02936), *Bacteroides plebeius* DSM 17135 (BACPLE_00693), *Desulfohalobium retbaense* DSM 5692 (DRET_1725), *Desulfotomaculum acetoxidans* DSM 771 (DTOX_0604), *Pedobacter heparinus* DSM 2366 (PHEP_3664), *Chitinophaga pinensis* DSM 2588 (CPIN_5466), *Flavobacteria bacterium* MS024-2A (FLAV2ADRAFT_0090), *Flavobacteria bacterium* MS024-3C (FLAV3CDRAFT_0851), *Moorea producta* 3L (LYNGBM3L_14400), *Anoxybacillus flavithermus* WK1 (AFLV_0149), *Mycoplasma fermentans* PG18

(MBIO_0474), *Chthoniobacter flavus* Ellin428 (CFE428DRAFT_3031), *Cyanothece* sp. PCC 7822 (CYAN7822_1152), *Borrelia spielmanii* A14S (BSPA145_0009), *Heliobacterium modesticaldum* Ice1 (HM1_1522), *Thermus aquaticus* Y51MC23 (TAQDRAFT_3938), *Clostridium sticklandii* DSM 519 (CLOST_0484), *Tepidanaerobacter* sp. Re1 (TEPRE1_0323), *Clostridium hiranonis* DSM 13275 (CLOHIR_00003), *Mitsuokella multacida* DSM 20544 (MITSMUL_03479), *Haliangium ochraceum* DSM 14365 (HOCH_3550), *Spirosoma linguale* DSM 74 (SLIN_2673), unidentified *eubacterium* SCB49 (SCB49_03679), *Acetivibrio cellulolyticus* CD2 (ACELC_020100013845), *Lactobacillus buchneri* NRRL B-30929 (LBUC_1299), *Butyrivibrio crossotus* DSM 2876 (BUTYVIB_02056), *Candidatus* Azobacteroides pseudotrichonymphae genomovar. CFP2 (CFPG_066), *Mycoplasma crocodyli* MP145 (MCRO_0385), *Arthrospira maxima* CS-328 (AMAXDRAFT_4184), *Eubacterium eligens* ATCC 27750 (EUBELI_01626), *Butyrivibrio proteoclasticus* B316 (BPR_I2587), *Chloroherpeton thalassium* ATCC 35110 (CTHA_1340), *Eubacterium biforme* DSM 3989 (EUBIFOR_01794), *Rhodothermus marinus* DSM 4252 (RMAR_0146), *Borrelia bissettii* DN127 (BBIDN127_0008), *Capnocytophaga ochracea* DSM 7271 (COCH_2107), *Alicyclobacillus acidocaldarius* subsp. *acidocaldarius* DSM 446 (AACI_2672), *Caldicellulosiruptor bescii* DSM 6725 (ATHE_0361), *Denitrovibrio acetiphilus* DSM 12809 (DACET_1298), *Desulfovibrio desulfuricans* subsp. *desulfuricans* str. ATCC 27774 (DDES_1715), *Anaerococcus lactolyticus* ATCC 51172 (HMPREF0072_1645), *Anaerococcus tetradius* ATCC 35098 (HMPREF0077_0902), *Finegoldia magna* ATCC 53516 (HMPREF0391_10377), *Lactobacillus antri* DSM 16041 (YBBP), *Lactobacillus buchneri* ATCC 11577 (HMPREF0497_2752), *Lactobacillus ultunensis* DSM 16047 (HMPREF0548_0745), *Lactobacillus vaginalis* ATCC 49540 (HMPREF0549_0766), *Listeria grayi* DSM 20601 (HMPREF0556_11652), *Sphingobacterium spiritivorum* ATCC 33861 (HMPREF0766_11787), *Staphylococcus epidermidis* M23864:W1 (HMPREF0793_0092), *Streptococcus equinus* ATCC 9812 (HMPREF0819_0812), *Desulfomicrobium baculatum* DSM 4028 (DBAC_0255), *Thermanaerovibrio acidaminovorans* DSM 6589 (TACI_0837), *Thermobaculum terrenum* ATCC BAA-798 (TTER_1817), *Anaerococcus prevotii* DSM 20548 (APRE_0370), *Desulfovibrio salexigens* DSM 2638 (DESAL_1795), *Brachyspira murdochii* DSM 12563 (BMUR_2186), *Meiothermus silvanus* DSM 9946 (MESIL_0161), *Bacillus cereus* Rock4-18 (BCERE0024_1410), *Cylindrospermopsis raciborskii* CS-505 (CRC_01921), *Raphidiopsis brookii* D9 (CRD_01188), *Clostridium carboxidivorans* P7 2 seqs CLCAR_0016, CCARBDRAFT_4266), *Clostridium botulinum* E1 str. BoNT E Beluga (CLO_3490), *Blautia hansenii* DSM 20583 (BLAHAN_07155), *Prevotella copri* DSM 18205 (PREVCOP_04867), *Clostridium methylpentosum* DSM 5476 (CLOSTMETH_00084), *Lactobacillus casei* BL23 (LCABL_11800), *Bacillus megaterium* QM B1551 (BMQ_0195), *Treponema primitia* ZAS-2 (TREPR_1936), *Treponema azotonutricium* ZAS-9 (TREAZ_0147), *Holdemania filiformis* DSM 12042 (HOLDEFILI_03810), *Filifactor alocis* ATCC 35896 (HMPREF0389_00366), *Gemella haemolysans* ATCC 10379 (GEMHA0001_0912), *Selenomonas sputigena* ATCC 35185 (SELSP_1610), *Veillonella dispar* ATCC 17748 (VEIDISOL_01845), *Deinococcus deserti* VCD115 (DEIDE_19700), *Bacteroides coprophilus* DSM 18228 (BACCOPRO_00159), *Nostoc azollae* 0708 (AAZO_4735), *Erysipelotrichaceae bacterium* 5_2_54FAA (HMPREF0863_02273), *Ruminococcaceae bacterium* D16 (HMPREF0866_01061), *Prevotella bivia* JCVIHMP010 (HMPREF0648_0338), *Prevotella melaninogenica* ATCC 25845 (HMPREF0659_A6212), *Porphyromonas endodontalis* ATCC 35406 (POREN0001_0251), *Capnocytophaga sputigena* ATCC 33612 (CAPSP0001_0727), *Capnocytophaga gingivalis* ATCC 33624 (CAPGI0001_1936), *Clostridium hylemonae* DSM 15053 (CLOHYLEM_04631), *Thermosediminibacter oceani* DSM 16646 (TOCE_1970), *Dethiobacter alkaliphilus* AHT 1 (DEALDRAFT_0231), *Desulfonatronospira thiodismutans* AS03-1 (DTHIO_PD2806), *Clostridium* sp. D5 (HMPREF0240_03780), *Anaerococcus hydrogenalis* DSM 7454 (ANHYDRO_01144), *Kyrpidia tusciae* DSM 2912 (BTUS_0196), *Gemella haemolysans* M341 (HMPREF0428_01429), *Gemella morbillorum* M424 (HMPREF0432_01346), *Gemella sanguinis* M325 (HMPREF0433_01225), *Prevotella oris* C735 (HMPREF0665_01741), *Streptococcus* sp. M143 (HMPREF0850_00109), *Streptococcus* sp. M334 (HMPREF0851_01652), *Bilophila wadsworthia* 3_1_6 (HMPREF0179_00899), *Brachyspira hyodysenteriae* WA1 (BHWA1_01167), *Enterococcus gallinarum* EG2 (EGBG_00820), *Enterococcus casseliflavus* EC20 (ECBG_00827), *Enterococcus faecium* C68 (EFXG_01665), *Syntrophus aciditrophicus* SB (SYN_02762), *Lactobacillus rhamnosus* GG 2 seqs OSSG, LRHM_0937), *Acidaminococcus intestini* RyC-MR95 (ACIN_2069), *Mycoplasma conjunctivae* HRC/581 (MCJ_002940), *Halanaerobium praevalens* DSM 2228 (HPRAE_1647), *Aminobacterium colombiense* DSM 12261 (AMICO_0737), *Clostridium cellulovorans* 743B (CLOCEL_3678), *Desulfovibrio magneticus* RS-1 (DMR_25720), *Spirochaeta smaragdinae* DSM 11293 (SPIRS_1647), Bacteroidetes oral taxon 274 str. F0058 (HMPREF0156_01826), Lachnospiraceae oral taxon 107 str. F0167 (HMPREF0491_01238), *Lactobacillus coleohominis* 101-4-CHN (HMPREF0501_01094), *Lactobacillus jensenii* 27-2-CHN (HMPREF0525_00616), *Prevotella buccae* D17 (HMPREF0649_02043), *Prevotella* sp. oral taxon 299 str. F0039 (HMPREF0669_01041), *Prevotella* sp. oral taxon 317 str. F0108 (HMPREF0670_02550), *Desulfobulbus propionicus* DSM 2032 2 seqs DESPR_2503, DESPR_1053), *Thermoanaerobacterium thermosaccharolyticum* DSM 571 (TTHE_0484), *Thermoanaerobacter italicus* Ab9 (THIT_1921), *Thermovirga lienii* DSM 17291 (TLIE_0759), *Aminomonas paucivorans* DSM 12260 (APAU_1274), *Streptococcus mitis* SK321 (SMSK321_0127), *Streptococcus mitis* SK597 (SMSK597_0417), *Roseburia hominis* A2-183 (RHOM_12405), *Oribacterium sinus* F0268 (HMPREF6123_0887), *Prevotella bergensis* DSM 17361 (HMPREF0645_2701), *Selenomonas noxia* ATCC 43541 (YBBP), *Weissella paramesenteroides* ATCC 33313 (HMPREF0877_0011), *Lactobacillus amylolyticus* DSM 11664 (HMPREF0493_1017), *Bacteroides* sp. D20 (HMPREF0969_02087), *Clostridium papyrosolvens* DSM 2782 (CPAP_3968), *Desulfurivibrio alkaliphilus* AHT2 (DAAHT2_0445), *Acidaminococcus fermentans* DSM 20731 (ACFER_0601), *Abiotrophia defectiva* ATCC 49176 (GCWU000182_00063), *Anaerobaculum hydrogeniformans* ATCC BAA-1850 (HMPREF1705_01115), *Catonella morbi* ATCC 51271 (GCWU000282_00629), *Clostridium botulinum* D str. 1873 (CLG_B1859), *Dialister invisus* DSM 15470 (GCWU000321_01906), *Fibrobacter succinogenes* subsp. *succinogenes* S85 2 seqs FSU_0028, FISUC_2776), *Desulfovibrio fructosovorans* JJ (DESFRDRAFT_2879), *Peptostreptococcus stomatis* DSM 17678 (HMPREF0634_0727), *Staphylococcus warneri* L37603 (STAWA0001_0094), *Treponema vincentii* ATCC 35580 (TREVI0001_1289), *Porphyromonas uenonis* 60-3 (PORUE0001_0199), *Peptostreptococcus anaerobius* 653-L (HMPREF0631_1228), *Peptoniphilus lacrimalis* 315-B (HMPREF0628_0762), *Candidatus* Phytoplasma *australiense* (PA0090), *Prochlorococcus marinus* subsp. *pastoris* str. CCMP1986 (PMM1091), *Synechococcus* sp. WH 7805 (WH7805_04441), *Blattabacterium* sp. (*Periplaneta americana*) str. BPLAN (BPLAN_534), *Caldicellulosiruptor obsidiansis* OB47 (COB47_0325), *Oribacterium* sp. oral taxon 078 str. F0262 (GCWU000341_01365), *Hydrogenobacter thermophilus* TK-6 2 seqs AD046034.1, HTH_1665), *Clostridium saccharolyticum* WM1 (CLOSA_1248), *Prevotella* sp. oral taxon 472 str. F0295 (HMPREF6745_1617), *Paenibacillus* sp. oral taxon 786 str. D14 (POTG_03822), *Roseburia inulinivorans* DSM 16841 2 seqs ROSEINA2194_02614, ROSEINA2194_02613), *Granulicatella elegans* ATCC 700633 (HMPREF0446_01381), *Prevotella tannerae* ATCC 51259 (GCWU000325_02844), *Shuttleworthia satelles* DSM 14600 (GCWU000342_01722), *Phascolarctobacterium succinatutens* YIT 12067 (HMPREF9443_01522), *Clostridium butyricum* E4 str. BoNT E BL5262 (CLP_3980), *Caldicellulosiruptor hydrothermalis* 108 (CALHY_2287), *Caldicellulosiruptor kristjanssonii* 177R1B (CALKR_0314), *Caldicellulosiruptor owensensis* OL (CALOW_0228), *Eubacterium cellulosolvens* 6 (EUBCEDRAFT_1150), *Geobacillus thermoglucosidasius* C56-YS93 (GEOTH_0175), *Thermincola potens* JR (THERJR_0376), *Nostoc punctiforme* PCC 73102 (NPUN_F5990), *Granulicatella adiacens* ATCC 49175 (YBBP), *Selenomonas flueggei* ATCC 43531 (HMPREF0908_1366), *Thermocrinis albus* DSM 14484 (THAL_0234), *Deferribacter desulfuricans* SSM1 (DEFDS_1031), *Ruminococcus flavefaciens* FD-1 (RFLAF_010100012444), *Desulfovibrio desulfuricans* ND132 (DND132_0877), *Clostridium lentocellum* DSM 5427 (CLOLE_3370), *Desulfovibrio aespoeensis* Aspo-2 (DAES_1257), *Syntrophothermus lipocalidus* DSM 12680 (SLIP_2139), *Marivirga tractuosa* DSM 4126 (FTRAC_3720), *Desulfarculus baarsii* DSM 2075 (DEBA_0764), *Synechococcus* sp. CC9311 (SYNC_1030), *Thermaerobacter marianensis* DSM 12885 (TMAR_0236), *Desulfovibrio* sp. FW1012B (DFW101_0480), *Jonquetella anthropi* E3_33 E1 (GCWU000246_01523), *Syntrophobotulus glycolicus* DSM 8271 (SGLY_0483), *Thermovibrio ammonificans* HB-1 (THEAM_0892), *Truepera radiovictrix* DSM 17093 (TRAD_1704), *Bacillus cellulosilyticus* DSM 2522 (BCELL_0170), *Prevotella veroralis* F0319 (HMPREF0973_02947), *Erysipelothrix rhusiopathiae* str. Fujisawa (ERH_0115), *Desulfurispirillum indicum* S5 (SELIN_2326), *Cyanothece* sp. PCC 7424 (PCC7424_0843), *Anaerococcus vaginalis* ATCC 51170 (YBBP), *Aerococcus viridans* ATCC 11563 (YBBP), *Streptococcus oralis* ATCC 35037 2 seqs HMPREF8579_1682, SMSK23_1115), *Zunongwangia profunda* SM-A87 (ZPR_0978), *Halanaerobium hydrogeniformans* (HALSA_1882), *Bacteroides xylanisolvens* XB1A (BXY_29650), *Ruminococcus torques* L2-14 (RTO_16490), *Ruminococcus obeum* A2-162 (CK5_33600), *Eubacterium rectale* DSM 17629 (EUR_24910), *Faecalibacterium prausnitzii* SL3/3 (FPR_27630), *Ruminococcus* sp. SR1/5 (CK1_39330), *Lachnospiraceae bacterium* 3_1_57FAA_CT1 (HMPREF0994_01490), *Lachnospiraceae bacterium* 9_1_43BFAA (HMPREF0987_01591), *Lachnospiraceae bacterium* 1_4_56FAA (HMPREF0988_01806), *Erysipelotrichaceae bacterium* 3_1_53 (HMPREF0983_01328), *Ethanoligenens harbinense* YUAN-3 (ETHHA_1605), *Streptococcus dysgalactiae* subsp. *dysgalactiae* ATCC 27957 (SDD27957_06215), *Spirochaeta thermophila* DSM 6192 (STHERM_C18370), *Bacillus* sp. 2_A_57_CT2 (HMPREF1013_05449), *Bacillus clausii* KSM-K16 (ABC0241), *Thermodesulfatator indicus* DSM 15286 (THEIN_0076), *Bacteroides salanitronis* DSM 18170 (BACSA_1486), *Oceanithermus profundus* DSM 14977 (OCEPR_2178), *Prevotella timonensis* CRIS 5C-B1 (HMPREF9019_2028), *Prevotella buccalis* ATCC 35310 (HMPREF0650_0675), *Prevotella amnii* CRIS 21A-A (HMPREF9018_0365), *Bulleidia extructa* W1219 (HMPREF9013_0078), *Bacteroides coprosuis* DSM 18011 (BCOP_0558), *Prevotella multisaccharivorax* DSM 17128 (PREMU_0839), *Cellulophaga algicola* DSM 14237 (CELAL_0483), *Synechococcus* sp. WH 5701 (WH5701_10360), *Desulfovibrio africanus* str. Walvis Bay (DESAF_3283), *Oscillibacter valericigenes* Sjm18-20 (OBV_23340), *Deinococcus proteolyticus* MRP (DEIPR_0134), *Bacteroides helcogenes* P 36-108 (BACHE_0366), *Paludibacter propionicigenes* WB4 (PALPR_1923), *Desulfotomaculum nigrificans* DSM 574 (DESNIDRAFT_2093), *Arthrospira platensis* NIES-39 (BAI89442.1), *Mahella australiensis* 50-1 BON (MAHAU_1846), *Thermoanaerobacter wiegelii* Rt8.B1 (THEWI_2191), *Ruminococcus albus* 7 (RUMAL_2345), *Staphylococcus lugdunensis* HKU09-01 (SLGD_00862), *Megasphaera* genomosp. typei str. 28L (HMPREF0889_1099), *Clostridiales* genomosp. BVAB3 str. UPII9-5 (HMPREF0868_1453), *Pediococcus claussenii* ATCC BAA-344 (PECL_571), *Prevotella oulorum* F0390 (HMPREF9431_01673), *Turicibacter sanguinis* PC909 (CUW_0305), *Listeria seeligeri* FSL N1-067 (NT03LS_2473), *Solobacterium moorei* F0204 (HMPREF9430_01245), *Megasphaera micronuciformis* F0359 (HMPREF9429_00929), *Capnocytophaga* sp. oral taxon 329 str. F0087 2 seqs HMPREF9074_00867, HMPREF9074_01078), *Streptococcus anginosus* F0211 (HMPREF0813_00157), *Mycoplasma suis* KI3806 (MSUI04040), *Mycoplasma gallisepticum* str. F (MGF_2771), *Deinococcus maricopensis* DSM 21211 (DEIMA_0651), *Odoribacter splanchnicus* DSM 20712 (ODOSP_0239), *Lactobacillus fermentum* CECT 5716 (LC40_0265), *Lactobacillus iners* AB-1 (LINEA_010100006089), cyanobacterium UCYN-A (UCYN_03150), *Lactobacillus sanfranciscensis* TMW 1.1304 (YBBP), *Mucilaginibacter paludis* DSM 18603 (MUCPA_1296), *Lysinibacillus fusiformis* ZC1 (BFZC1_03142), *Paenibacillus vortex* V453 (PVOR_30878), *Waddlia chondrophila* WSU 86-1044 (YBBP), *Flexistipes sinusarabici* DSM 4947 (FLEXSI_0971), *Paenibacillus curdlanolyticus* YK9 (PAECUDRAFT_1888), *Clostridium* cf. *saccharolyticum* K10 (CLS_03290), *Alistipes shahii* WAL 8301 (AL1_02190), *Eubacterium cylindroides* T2-87 (EC1_00230), *Coprococcus catus* GD/7 (CC1_32460), *Faecalibacterium prausnitzii* L2-6 (FP2_09960), *Clostridium clariflavum* DSM 19732 (CLOCL_2983), *Bacillus atrophaeus* 1942 (BATR1942_19530), *Mycoplasma pneumoniae* FH (MPNE_0277), *Lachnospiraceae bacterium* 2_1_46FAA (HMPREF9477_00058), *Clostridium symbiosum* WAL-14163 (HMPREF9474_01267), *Dysgonomonas gadei* ATCC BAA-286 (HMPREF9455_02764), *Dysgonomonas mossii* DSM 22836 (HMPREF9456_00401), *Thermus scotoductus* SA-01 (TSC_C24350), *Sphingobacte-* rium sp. 21 (SPH21_1233), *Spirochaeta caldaria* DSM 7334 (SPICA_1201), *Prochlorococcus marinus* str. MIT 9312 (PMT9312_1102), *Prochlorococcus marinus* str. MIT 9313 (PMT_1058), *Faecalibacterium* cf. *prausnitzii* KLE1255 (HMPREF9436_00949), *Lactobacillus crispatus* ST1 (LCRIS_00721), *Clostridium ljungdahlii* DSM 13528 (CLJU_C40470), *Prevotella bryantii* B14 (PBR_2345), *Treponema phagedenis* F0421 (HMPREF9554_02012), *Clostridium* sp. BNL1100 (CLO1100_2851), *Microcoleus vaginatus* FGP-2 (MICVADRAFT_1377), *Brachyspira pilosicoli* 95/1000 (BP951000_0671), *Spirochaeta coccoides* DSM 17374 (SPICO_1456), *Haliscomenobacter hydrossis* DSM 1100 (HALHY_5703), *Desulfotomaculum kuznetsovii* DSM 6115 (DESKU_2883), *Runella slithyformis* DSM 19594 (RUNSL_2859), *Leuconostoc kimchii* IMSNU 11154 (LKI_08080), *Leuconostoc gasicomitatum* LMG 18811 (OSSG), *Pedobacter saltans* DSM 12145 (PEDSA_3681), *Paraprevotella xylaniphila* YIT 11841 (HMPREF9442_00863), *Bacteroides clarus* YIT 12056 (HMPREF9445_01691), *Bacteroides fluxus* YIT 12057 (HMPREF9446_03303), *Streptococcus urinalis* 2285-97 (STRUR_1376), *Streptococcus macacae* NCTC 11558 (STRMA_0866), *Streptococcus ictaluri* 707-05 (STRIC_0998), *Oscillochloris trichoides* DG-6 (OSCT_2821), *Parachlamydia acanthamoebae* UV-7 (YBBP), *Prevotella denticola* F0289 (HMPREF9137_0316), *Parvimonas* sp. oral taxon 110 str. F0139 (HMPREF9126_0534), *Calditerrivibrio nitroreducens* DSM 19672 (CALNI_1443), *Desulfosporosinus orientis* DSM 765 (DESOR_0366), *Streptococcus mitis* by. 2 str. F0392 (HMPREF9178_0602), *Thermodesulfobacterium* sp. OPB45 (TOPB45_1366), *Synechococcus* sp. WH 8102 (SYNW0935), *Thermoanaerobacterium xylanolyticum* LX-11 (THEXY_0384), *Mycoplasma haemofelis* Ohio2 (MHF_1192), *Capnocytophaga canimorsus* Cc5 (CCAN_16670), *Pediococcus acidilactici* DSM 20284 (HMPREF0623_1647), *Prevotella marshii* DSM 16973 (HMPREF0658_1600), *Peptoniphilus duerdenii* ATCC BAA-1640 (HMPREF9225_1495), *Bacteriovorax marinus* SJ (BMS_2126), *Selenomonas* sp. oral taxon 149 str. 67H29BP (HMPREF9166_2117), *Eubacterium yurii* subsp. *margaretiae* ATCC 43715 (HMPREF0379_1170), *Streptococcus mitis* ATCC 6249 (HMPREF8571_1414), *Streptococcus* sp. oral taxon 071 str. 73H25AP (HMPREF9189_0416), *Prevotella disiens* FB035-09AN (HMPREF9296_1148), *Aerococcus urinae* ACS-120-V-Col10a (HMPREF9243_0061), *Veillonella atypica* ACS-049-V-Sch6 (HMPREF9321_0282), *Cellulophaga lytica* DSM 7489 (CELLY_2319), *Thermaerobacter subterraneus* DSM 13965 (THESUDRAFT_0411), *Desulfurobacterium thermolithotrophum* DSM 11699 (DESTER_0391), *Treponema succinifaciens* DSM 2489 (TRESU_1152), *Marinithermus hydrothermalis* DSM 14884 (MARKY_1861), *Streptococcus infantis* SK1302 (SIN_0824), *Streptococcus parauberis* NCFD 2020 (SPB_0808), *Streptococcus porcinus* str. Jelinkova 176 (STRPO_0164), *Streptococcus criceti* HS-6 (STRCR_1133), *Capnocytophaga ochracea* F0287 (HMPREF1977_0786), *Prevotella oralis* ATCC 33269 (HMPREF0663_10671), *Porphyromonas asaccharolytica* DSM 20707 (PORAS_0634), *Anaerococcus prevotii* ACS-065-V-Co113 (HMPREF9290_0962), *Peptoniphilus* sp. oral taxon 375 str. F0436 (HMPREF9130_1619), *Veillonella* sp. oral taxon 158 str. F0412 (HMPREF9199_0189), *Selenomonas* sp. oral taxon 137 str. F0430 (HMPREF9162_2458), *Cyclobacterium marinum* DSM 745 (CYCMA_2525), *Desulfobacca acetoxidans* DSM 11109 (DESAC_1475), *Listeria ivanovii* subsp. *ivanovii* PAM 55 (LIV_2111), *Desulfovibrio vulgaris* str. Hildenborough (DVU_1280), *Desulfovibrio vulgaris* str. 'Miyazaki F' (DVMF_0057), *Muricauda ruestringensis* DSM 13258 (MURRU_0474), *Leuconostoc argentinum* KCTC 3773 (LARGK3_010100008306), *Paenibacillus polymyxa* SC2 (PPSC2_C4728), *Eubacterium saburreum* DSM 3986 (HMPREF0381_2518), *Pseudoramibacter alactolyticus* ATCC 23263 (HMP0721_0313), *Streptococcus parasanguinis* ATCC 903 (HMPREF8577_0233), *Streptococcus sanguinis* ATCC 49296 (HMPREF8578_1820), *Capnocytophaga* sp. oral taxon 338 str. F0234 (HMPREF9071_1325), *Centipeda periodontii* DSM 2778 (HMPREF9081_2332), *Prevotella multiformis* DSM 16608 (HMPREF9141_0346), *Streptococcus peroris* ATCC 700780 (HMPREF9180_0434), *Prevotella salivae* DSM 15606 (HMPREF9420_1402), *Streptococcus australis* ATCC 700641 2 seqs HMPREF9961_0906, HMPREF9421_1720), *Streptococcus cristatus* ATCC 51100 2 seqs HMPREF9422_0776, HMPREF9960_0531), *Lactobacillus acidophilus* 30SC (LAC30SC_03585), *Eubacterium limosum* KIST612 (ELI_0726), *Streptococcus downei* F0415 (HMPREF9176_1204), *Streptococcus* sp. oral taxon 056 str. F0418 (HMPREF9182_0330), *Oribacterium* sp. oral taxon 108 str. F0425 (HMPREF9124_1289), *Streptococcus vestibularis* F0396 (HMPREF9192_1521), *Treponema brennaborense* DSM 12168 (TREBR_1165), *Leuconostoc fallax* KCTC 3537 (LFALK3_010100008689), *Eremococcus coleocola* ACS-139-V-Col8 (HMPREF9257_0233), *Peptoniphilus harei* ACS-146-V-Sch2b (HMPREF9286_0042), *Clostridium* sp. HGF2 (HMPREF9406_3692), *Alistipes* sp. HGBS (HMPREF9720_2785), *Prevotella dentalis* DSM 3688 (PREDE_0132), *Streptococcus pseudoporcinus* SPIN 20026 (HMPREF9320_0643), *Dialister microaerophilus* UPII 345-E (HMPREF9220_0018), *Weissella cibaria* KACC 11862 (WCIBK1_010100001174), *Lactobacillus coryniformis* subsp. *coryniformis* KCTC 3167 (LCORCK3_010100001982), *Synechococcus* sp. PCC 7335 (S7335_3864), *Owenweeksia hongkongensis* DSM 17368 (OWEHO_3344), *Anaerolinea thermophila* UNI-1 (ANT_09470), *Streptococcus oralis* Uo5 (SOR_0619), *Leuconostoc gelidum* KCTC 3527 (LGELK3_010100006746), *Clostridium botulinum* BKT015925 (CBC4_0275), *Prochlorococcus marinus* str. MIT 9211 (P9211_10951), *Prochlorococcus marinus* str. MIT 9215 (P9215_12271), *Staphylococcus aureus* subsp. *aureus* NCTC 8325 (SAOUHSC_02407), *Staphylococcus aureus* subsp. *aureus* COL (SACOL2153), *Lactobacillus animalis* KCTC 3501 (LANIK3_010100000290), *Fructobacillus fructosus* KCTC 3544 (FFRUK3_010100006750), *Acetobacterium woodii* DSM 1030 (AWO_C28200), *Planococcus donghaensis* MPA1U2 (GPDM_12177), *Lactobacillus farciminis* KCTC 3681 (LFARK3_010100009915), *Melissococcus plutonius* ATCC 35311 (MPTP_0835), *Lactobacillus fructivorans* KCTC 3543 (LFRUK3_010100002657), *Paenibacillus* sp. HGF7 (HMPREF9413_5563), *Lactobacillus oris* F0423 (HMPREF9102_1081), *Veillonella* sp. oral taxon 780 str. F0422 (HMPREF9200_1112), *Parvimonas* sp. oral taxon 393 str. F0440 (HMPREF9127_1171), *Tetragenococcus halophilus* NBRC 12172 (TEH_13100), *Candidatus* Chloracidobacterium *thermophilum* B (CABTHER_A1277), *Ornithinibacillus scapharcae* TW25 (OTW25_010100020393), *Lacinutrix* sp. 5H-3-7-4 (LACAL_0337), *Krokinobacter* sp. 4H-3-7-5 (KRODI_0177), *Staphylococcus pseudintermedius* ED99 (SPSE_0659), *Staphylococcus aureus* subsp. *aureus* MSHR1132 (CCE59824.1), *Paenibacillus terrae* HPL-003

(HPL003_03660), *Caldalkalibacillus thermarum* TA2.A1 (CATHTA2_0882), *Desmospora* sp. 8437 (HM-PREF9374_2897), *Prevotella nigrescens* ATCC 33563 (HMPREF9419_1415), *Prevotella pallens* ATCC 700821 (HMPREF9144_0175), *Streptococcus infantis* X (HM-PREF1124.

In any of these embodiments, the bacteria genetically engineered to produce cyclic-di-AMP produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more cyclic-di-AMP than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more cyclic-di-AMP than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more cyclic-di-AMP than unmodified bacteria of the same bacterial subtype under the same conditions.

In any of these embodiments, the bacteria genetically engineered to produce cyclic-di-AMP consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more ATP than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more ATP than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more ATP than unmodified bacteria of the same bacterial subtype under the same conditions.

In any of these embodiments, the bacteria genetically engineered to produce cyclic-di-GAMP produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more cyclic-di-GAMP than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more cyclic-di-GAMP than unmodified bacteria of the same bacterial subtype under the same conditions.

In any of these embodiments, the bacteria genetically engineered to produce cyclic-di-GAMP consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more ATP than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more ATP and/or GTP than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more ATP and/or GTP than unmodified bacteria of the same bacterial subtype under the same conditions.

In any of these embodiments, the genetically engineered bacteria increase STING agonist production rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the genetically engineered bacteria increase the STING agonist production rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase STING agonist production rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one embodiment, the genetically engineered bacteria increase STING agonist production by about 80% to 100% relative to unmodified bacteria of the same bacterial subtype under the same conditions, after 4 hours. In one embodiment, the genetically engineered bacteria increase STING agonist production by about 90% to 100% relative to unmodified bacteria of the same bacterial subtype under the same conditions after 4 hours. In one specific embodiment, the genetically engineered bacteria increase STING agonist production by about 95% to 100% relative to unmodified bacteria of the same bacterial subtype under the same conditions, after 4 hours. In one specific embodiment, the genetically engineered bacteria increase the STING agonist production by about 99% to 100% relative to unmodified bacteria of the same bacterial subtype under the same conditions, after 4 hours. In yet another embodiment, the genetically engineered bacteria increase the STING agonist production by about 10-50 fold after 4 hours. In yet another embodiment, the genetically engineered bacteria increase STING agonist production by about 50-100 fold after 4 hours. In yet another embodiment, the genetically engineered bacteria increase STING agonist production by about 100-500 fold after 4 hours. In yet another embodiment, the genetically engineered bacteria increase STING agonist production by about 500-1000 fold after 4 hours. In yet another embodiment, the genetically engineered bacteria increase the STING agonist production by about 1000-5000 fold after 4 hours. In yet another embodiment, the genetically engineered bacteria increase the STING agonist production by about 5000-10000 fold after 4 hours. In yet another embodiment, the genetically engineered bacteria increase STING agonist production by about 10000-1000 fold after 4 hours.

In any of these STING agonist production embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these agonist STING production embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria comprising gene sequences encoding dacA (or another enzyme for the production of a STING agonists) are able to increase IFN-β1 mRNA levels in macrophages and/or dendritic cells, e.g., in cell culture. In some embodiments, the IFN-β1 mRNA increase dependent on the dose of bacteria administered. In some embodiments, the genetically engineered bacteria comprising gene sequences encoding dacA (or another enzyme for the production of a STING agonists) are able to increase IFN-β1 mRNA levels in macrophages and/or dendritic cells, e.g., in the tumor. In some embodiments, the IFN-beta1 increase is dependent on the dosage of bacteria administered.

In one embodiment, IFN-beta1 production in tumors is about two-fold, about 3-fold, about 4-fold as compared to levels of IFN-beta1 production observed upon administration of an unmodified bacteria of the same subtype under the same conditions, e.g., at day 2 after first injection of the bacteria. In some embodiments, the genetically engineered bacteria induce the production of about 6,000 to 25,000, 15,000 to 25,000, 6,000 to 8,000, 20,000 to 25,000 pg/ml IFN b1 mRNA in bone marrow-derived dendritic cells, e.g., at 4 hours post-stimulation.

In some embodiments, the genetically engineered bacteria comprising gene sequences encoding dacA (or another enzyme for the production of a STING agonists) can dose-dependently increase IFN-b1 production in bone marrow-derived dendritic cells, e.g., at 2 or 4 hours post stimulation.

In some embodiments, the genetically engineered bacteria comprising gene sequences encoding dacA (or another enzyme for the production of a STING agonists) are able to reduce tumor volume, e.g., at 4 or 9 days after a regimen of 3 bacterial treatments, relative to an unmodified bacteria of the same subtype under the same conditions. In a non-limiting example, the tumor volume is about 0 to 30 mm3 after 9 days.

In some embodiments, the bacteria genetically engineered to produce STING agonists are capable of increasing the response rate by at least about 10%, 20%, 25%, 30%, 40%, 50%, 60%, 70%, 75%, 80%, 85%, 90%, 95%, 98% or more as compared to an unmodified bacteria of the same subtype under the same conditions. In some embodiments, the genetically engineered bacteria comprising gene sequences encoding dacA, achieve a 100% response rate.

In some embodiments, the response rate is about 1.0-1.2-fold, 1.2-1.4-fold, 1.4-1.6-fold, 1.6-1.8-fold, 1.8-2-fold, or two-fold than observed with than unmodified bacteria of the same bacterial subtype under the same conditions. In yet another embodiment, the response rate is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more than observed with unmodified bacteria of the same bacterial subtype under the same conditions.

In some embodiments, the genetically engineered bacteria comprising gene sequences encoding c-di-GAMP synthases, diadenylate cyclases, or other STING agonist producing polypeptides, achieve a tumor regression by at least about 10%, 20%, 25%, 30%, 40%, 50%, 60%, 70%, 75%, 80%, 85%, 90%, 95%, 98% or more as compared to an unmodified bacteria of the same subtype under the same conditions. In some embodiments, the tumor regression is about 1.0-1.2-fold, 1.2-1.4-fold, 1.4-1.6-fold, 1.6-1.8-fold, 1.8-2-fold, or two-fold than observed with than unmodified bacteria of the same bacterial subtype under the same conditions. In yet another embodiment, the tumor regression is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more than observed with unmodified bacteria of the same bacterial subtype under the same conditions.

In some embodiments, the genetically engineered bacteria comprising gene sequences encoding dacA (or other enzymes for production of STING agonists) increase total T cell numbers in the tumor draining lymph nodes. In some embodiments, the increase in total T cell numbers in the tumor draining lymph nodes is at least about 10%, 20%, 25%, 30%, 40%, 50%, 60%, 70%, 75%, 80%, 85%, 90%, 95%, 98% or more as compared to an unmodified bacteria of the same subtype under the same conditions. In some embodiments, the increase in total T cell numbers is about 1.0-1.2-fold, 1.2-1.4-fold, 1.4-1.6-fold, 1.6-1.8-fold, 1.8-2-fold, or two-fold than observed with than unmodified bacteria of the same bacterial subtype under the same conditions. In yet another embodiment, the increase in total T cell numbers is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more than observed with unmodified bacteria of the same bacterial subtype under the same conditions.

In some embodiments, the genetically engineered bacteria comprising gene sequences encoding dacA (or other enzymes for production of STING agonists) increase the percentage of activated effector CD4 and CD8 T cells in tumor draining lymph nodes.

In some embodiments, the percentage of activated effector CD4 and CD8 T cells in the tumor draining lymph nodes is at least about 10%, 20%, 25%, 30%, 40%, 50%, 60%, 70%, 75%, 80%, 85%, 90%, 95%, 98% or more as compared to an unmodified bacteria of the same subtype under the same conditions. In some embodiments, the percentage of activated effector CD4 and CD8 T cells is about 1.0-1.2-fold, 1.2-1.4-fold, 1.4-1.6-fold, 1.6-1.8-fold, 1.8-2-fold, or two-fold than observed with than unmodified bacteria of the same bacterial subtype under the same conditions. In yet another embodiment, the percentage of activated effector CD4 and CD8 T cells is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more than observed with unmodified bacteria of the same bacterial subtype under the same conditions. In one embodiment, the gene encoded by the bacteria is DacA and the percentage of activated effector CD4 and CD8 T cells is two to four fold more than observed with unmodified bacteria of the same bacterial subtype under the same conditions.

In some embodiments, the genetically engineered bacteria comprising gene sequences encoding dacA (or other enzymes for production of STING agonists) achieve early rise of innate cytokines inside the tumor and a later rise of an effector-T-cell response.

In some embodiments, the genetically engineered bacteria comprising gene sequences encoding dacA (or other enzymes for production of STING agonists) in the tumor microenvironment are able to overcome immunological suppression and generating robust innate and adaptive antitumor immune responses. In some embodiments, the genetically engineered bacteria comprising gene sequences encoding dacA Inhibit proliferation or accumulation of regulatory T cells.

In some embodiments, the genetically engineered bacteria comprising gene sequences encoding dacA (or other enzymes for production of STING agonists) achieve early rise of innate cytokines inside the tumor, including but not limited to IL-6, IL-1beta, and MCP-1.

In some embodiments IL-6 is at least about 10%, 20%, 25%, 30%, 40%, 50%, 60%, 70%, 75%, 80%, 85%, 90%, 95%, 98% or more induced as compared to an unmodified bacteria of the same subtype under the same conditions. In some embodiments, IL-6 is about 1.0-1.2-fold, 1.2-1.4-fold, 1.4-1.6-fold, 1.6-1.8-fold, 1.8-2-fold, or two-fold more induced than observed with than unmodified bacteria of the same bacterial subtype under the same conditions. In yet another embodiment, the IL-6 is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more induced than observed with unmodified bacteria of the same bacterial subtype under the same conditions. In one embodiment, the gene encoded by the bacteria is dacA and the levels of induced IL-6 is about two to three-fold greater than observed with unmodified bacteria of the same bacterial subtype under the same conditions.

In some embodiments, the levels of IL-1beta in the tumor is at least about 10%, 20%, 25%, 30%, 40%, 50%, 60%, 70%, 75%, 80%, 85%, 90%, 95%, 98% or more elevated as compared to an unmodified bacteria of the same subtype under the same conditions. In some embodiments, the levels of IL-1beta are about 1.0-1.2-fold, 1.2-1.4-fold, 1.4-1.6-fold, 1.6-1.8-fold, 1.8-2-fold, or two-fold or more elevated than observed with than unmodified bacteria of the same bacterial subtype under the same conditions. In yet another embodiment, levels of IL-1beta are about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more elevated than observed with unmodified bacteria of the same bacterial subtype under the same conditions. In one embodiment, the gene encoded by the bacteria is DacA and levels of IL-1beta are about 2 fold, 3 fold, or 4 fold more than observed with unmodified bacteria of the same bacterial subtype under the same conditions.

In some embodiments, the levels of MCP1 in the tumor is at least about 10%, 20%, 25%, 30%, 40%, 50%, 60%, 70%, 75%, 80%, 85%, 90%, 95%, 98% or more elevated as compared to an unmodified bacteria of the same subtype under the same conditions. In some embodiments, the levels of MCP1 are about 1.0-1.2-fold, 1.2-1.4-fold, 1.4-1.6-fold, 1.6-1.8-fold, 1.8-2-fold, or two-fold or more elevated than observed with than unmodified bacteria of the same bacterial subtype under the same conditions. In yet another embodiment, levels of MCP1 are about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more elevated than observed with unmodified bacteria of the same bacterial subtype under the same conditions. In one embodiment, the gene encoded by the bacteria is DacA and levels of MCP1 are about 2 fold, 3 fold, or 4 fold more than observed with unmodified bacteria of the same bacterial subtype under the same conditions.

In some embodiments, the genetically engineered bacteria comprising gene sequences encoding dacA (or other enzymes for production of STING agonists) achieve activation of molecules relevant towards an effector-T-cell response, including but not limited to, Granzyme B, IL-2, and IL-15.

In some embodiments, the levels of granzyme B in the tumor is at least about 10%, 20%, 25%, 30%, 40%, 50%, 60%, 70%, 75%, 80%, 85%, 90%, 95%, 98% or more elevated as compared to an unmodified bacteria of the same subtype under the same conditions. In some embodiments, the levels of granzyme B are about 1.0-1.2-fold, 1.2-1.4-fold, 1.4-1.6-fold, 1.6-1.8-fold, 1.8-2-fold, or two-fold or more elevated than observed with than unmodified bacteria of the same bacterial subtype under the same conditions. In yet another embodiment, levels of granzyme B are about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more elevated than observed with unmodified bacteria of the same bacterial subtype under the same conditions. In one embodiment, the gene encoded by the bacteria is DacA and levels of granzyme B are about 2 fold, 3 fold, or 4 fold more than observed with unmodified bacteria of the same bacterial subtype under the same conditions.

In some embodiments, the levels of IL-2 in the tumor is at least about 10%, 20%, 25%, 30%, 40%, 50%, 60%, 70%, 75%, 80%, 85%, 90%, 95%, 98% or more elevated as compared to an unmodified bacteria of the same subtype under the same conditions. In some embodiments, the levels of IL-2 are about 1.0-1.2-fold, 1.2-1.4-fold, 1.4-1.6-fold, 1.6-1.8-fold, 1.8-2-fold, or two-fold or more elevated than observed with than unmodified bacteria of the same bacterial subtype under the same conditions. In yet another embodiment, levels of IL-2 are about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more elevated than observed with unmodified bacteria of the same bacterial subtype under the same conditions. In one embodiment, the gene encoded by the bacteria is DacA and the levels of IL-2 are about 3 fold, 4 fold, or 5 fold more than observed with unmodified bacteria of the same bacterial subtype under the same conditions.

In some embodiments, the levels of IL-15 in the tumor is at least about 10%, 20%, 25%, 30%, 40%, 50%, 60%, 70%, 75%, 80%, 85%, 90%, 95%, 98% or more elevated as compared to an unmodified bacteria of the same subtype under the same conditions. In some embodiments, the levels of IL-15 are about 1.0-1.2-fold, 1.2-1.4-fold, 1.4-1.6-fold, 1.6-1.8-fold, 1.8-2-fold, or two-fold or more elevated than observed with than unmodified bacteria of the same bacterial subtype under the same conditions. In yet another embodiment, levels of IL-15 are about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more elevated than observed with unmodified bacteria of the same bacterial subtype under the same conditions. In one embodiment, gene encoded by the bacteria is DacA and the levels of IL-15 are about 2 3 fold, 4 fold, or 5 fold more than observed with unmodified bacteria of the same bacterial subtype under the same conditions.

In some embodiments, the genetically engineered bacteria comprise a gene sequence encoding DacA. In one embodiment, the dacA gene has at least about 80% identity with a SEQ ID NO: 1210. In another embodiment, the dacA gene has at least about 85% identity with SEQ ID NO: 1210. In one embodiment, the dacA gene has at least about 90% identity with SEQ ID NO: 1210. In one embodiment, the dacA gene has at least about 95% identity with SEQ ID NO: 1210. In another embodiment, the dacA gene has at least about 96%, 97%, 98%, or 99% identity with SEQ ID NO: 1210. Accordingly, in one embodiment, the dacA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 1210. In another embodiment, the dacA gene comprises the sequence of SEQ ID NO: 1210. In yet another embodiment, the dacA gene consists of the sequence of SEQ ID NO: 1210.

In some embodiments, the genetically engineered bacteria comprise a gene sequence encoding a DacA polypeptide having at least about 80% identity with SEQ ID NO: 1209. In some embodiments, the genetically engineered bacteria comprise a gene sequence encoding a DacA polypeptide that has about having at least about 90% identity with SEQ ID NO: 1209. In some embodiments, the genetically engineered bacteria comprise a gene sequence encoding a DacA polypeptide that has about having at least about 95% identity with SEQ ID NO: 1209. In some embodiments, the genetically engineered bacteria comprise a gene sequence encoding a DacA polypeptide that has about 80%, 81%, 82%, 83%, 84%, 85%, 86%, 87%, 88%, 89%, 90%, 91%, 92%, 93%, 94%, 95%, 96%, 97%, 98%, or 99% identity to SEQ ID NO: 1209, or a functional fragment thereof. In another embodiment, the genetically engineered bacteria comprise a gene sequence encoding a DacA polypeptide comprising SEQ ID NO: 1209. In yet another embodiment, the polypeptide expressed by the genetically engineered bacteria consists of SEQ ID NO: 1209.

In some embodiments, the c-di-GAMP synthases, diadenylate cyclases, or other STING agonist producing polypeptides are modified and/or mutated, e.g., to enhance stability, or to increase STING agonism. In some embodiments, the genetically engineered bacteria and/or other microorganisms are capable of producing the c-di-GAMP synthases or other STING agonist producing polypeptides under inducing conditions, e.g., under a condition(s) associated with immune suppression and/or tumor microenvironment. In some embodiments, the genetically engineered bacteria and/or other microorganisms are capable of producing the c-di-GAMP synthases or other STING agonist producing polypeptides in low-oxygen conditions or hypoxic conditions, in the presence of certain molecules or metabolites, in the presence of molecules or metabolites associated with cancer, or certain tissues, immune suppression, or inflammation, or in the presence of some other metabolite that may or may not be present in the gut, circulation, or the tumor, such as arabinose.

In some embodiments, the genetically engineered bacteria encode c-di-GAMP synthases from *Vibrio cholerae*. In some embodiments, c-di-GAMP synthases from *Vibrio cholerae* is modified and/or mutated, e.g., to enhance stability, or to increase STING agonism.

In some embodiments, the genetically engineered bacteria encode cyclic-di-AMP synthases from *Listeria monocytogenes*. In some embodiments, diadenylate cyclases from *Listeria monocytogenes* is modified and/or mutated, e.g., to enhance stability, or to increase STING agonism. In some embodiments, the genetically engineered bacteria and/or other microorganisms are capable of producing the enzyme(s) for producing STING agonists, e.g., a cyclic-di-AMP synthase and/or under inducing conditions, e.g., under a condition(s) associated with immune suppression and/or tumor microenvironment. In some embodiments, the genetically engineered bacteria and/or other microorganisms are capable of producing STING agonist producing enzyme, e.g., a cyclic-di-AMP synthase, in low-oxygen conditions or hypoxic conditions, in the presence of certain molecules or metabolites, in the presence of molecules or metabolites associated with cancer, or certain tissues, immune suppression, or inflammation, or in the presence of some other metabolite that may or may not be present in the gut, circulation, or the tumor, such as arabinose.

In some embodiments, the genetically engineered bacteria and/or other microorganisms are capable of expressing any one or more of the described circuits, including but not limited to, circuitry for the expression of STING agonist producing enzyme, e.g., a cyclic-di-AMP synthase, e.g., from *Listeria monocytogenes*, in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut or the tumor, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacterial expansion, production and/or manufacture, as described herein.

In some embodiments, any one or more of the described circuits, including but not limited to, circuitry for the expression of a STING agonist producing enzyme, e.g., cyclic-di-AMP synthase, e.g., from *Listeria monocytogenes*, are present on one or more plasmids (e.g., high copy or low copy) or are integrated into one or more sites in the bacteria and/or other microorganism chromosome(s). Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art (7) one or more circuits for the production or degradation of one or more metabolites (e.g., kynurenine, tryptophan, adenosine, arginine) described herein and (8) combinations of one or more of such additional circuits. In any of these embodiments, the genetically engineered bacteria may be administered alone or in combination with one or more immune checkpoint inhibitors described herein, including but not limited to anti-CTLA4 antibodies or anti-PD1 or anti-PDL1 antibodies.

In one embodiment, administration of the STING agonist producing stain elicits an abscopal effect. In one embodiment, administration of genetically engineered bacteria comprising one or more genes encoding deadenylate cyclase elicits an abscopal effect. In one embodiment, the abscopal effect is observed between day 2 and day 3.

Activation of Effector Immune Cells (Immune Stimulators)
T-Cell Activators

Cytokines and Cytokine Receptors

CD4 (cluster of differentiation 4) is a glycoprotein found on the surface of immune cells such as cells, monocytes, macrophages, and dendritic cells. CD4+T helper cells are white blood cells that function to send signals to other types of immune cells, thereby assisting other immune cells in immunologic processes, including maturation of B cells into plasma cells and memory B cells, and activation of cytotoxic T cells and macrophages. T helper cells become activated when they are presented with peptide antigens by MHC class II molecules, which are expressed on the surface of antigen-presenting cells (APCs). Once activated, T helper cells divide and secrete cytokines that regulate or assist in the active immune response. T helper cells can differentiate into one of several subtypes, including TH1, TH2, TH3, TH17, TH9, or TFH cells, which secrete different cytokines to facilitate different types of immune responses.

Cytotoxic T cells (TC cells, or CTLs) destroy virus-infected cells and tumor cells, and are also implicated in transplant rejection. These cells are also known as CD8+ T cells since they express the CD8 glycoprotein at their surfaces. Cytotoxic T cells recognize their targets by binding to antigen associated with MHC class I molecules, which are present on the surface of all nucleated cells.

In some embodiments, the genetically engineered microorganisms, e.g., genetically engineered bacteria, are capable of producing one or more anti-cancer molecules that modulates one or more T effector cells, e.g., CD4+ cell and/or CD8+ cell. In some embodiments, the genetically engineered bacteria are capable of producing one or more anti-cancer molecules that activate, stimulate, and/or induce the differentiation of one or more T effector cells, e.g., CD4+ and/or CD8+ cells. In some embodiments, the immune modulator is a cytokine that activates, stimulates, and/or induces the differentiation of a T effector cell, e.g., CD4+ and/or CD8+ cells. In some embodiments, the genetically engineered bacteria produce one or more cytokines selected from IL-2, IL-15, IL-12, IL-7, IL-21, IL-18, TNF, and interferon gamma (IFN-gamma). As used herein, the production of one or more cytokines includes fusion proteins which comprise one or more cytokines, which are fused through a peptide linked to another cytokine or other immune modulatory molecule. Examples include but are not limited to IL-12 and IL-15 fusion proteins. In general, all agonists and antagonists described herein may be fused to another polypeptide of interest through a peptide linker, to improve or alter their function. For example, in some embodiments, the genetically engineered bacteria comprise sequence(s) encoding one or more cytokines selected from IL-2, IL-15, IL-12, IL-7, IL-21, IL-18, TNF, and IFN-gamma. In some embodiments, the genetically engineered microorganisms encode one or more cytokine fusion proteins. Non-limiting examples of such fusion proteins include one or more cytokine polypeptides operably linked to an antibody polypeptide, wherein the antibody recognizes a tumor-specific antigen, thereby bringing the cytokine(s) into proximity with the tumor.

Interleukin 12 (IL-12) is a cytokine, the actions of which create an interconnection between the innate and adaptive immunity. IL-12 is secreted by a number of immune cells, including activated dendritic cells, monocytes, macrophages, and neutrophils, as well as other cell types. IL-12 is a heterodimeric protein (IL-12-p70; IL-12-p35/p40) consisting of p35 and p40 subunits, and binds to a receptor composed of two subunits, IL-12R-β1 and IL-12R-β2. IL-12 receptor is expressed constitutively or inducibly on a number of immune cells, including NK cells, T, and B lymphocytes. Upon binding of IL-12, the receptor is activated and downstream signaling through the JAK/STAT pathway initiated, resulting in the cellular response to IL-12. IL-12 acts by increasing the production of IFN-γ, which is the most potent mediator of IL-12 actions, from NK and T cells. In addition, IL-12 promotes growth and cytotoxicity of activated NK cells, CD8+ and CD4+ T cells, and shifts the differentiation of CD4+Th0 cells toward the Th1 phenotype. Further, IL-12 enhances of antibody-dependent cellular cytotoxicity (ADCC) against tumor cells and the induction of IgG and suppression of IgE production from B cells. In addition, IL-12 also plays a role in reprogramming of myeloid-derived suppressor cells, directs the Th1-type immune response and helps increase expression of MHC class I molecules (e.g., reviewed in Waldmann et al., Cancer Immunol Res March 2015 3; 219).

Thus, in some embodiments, the engineered bacteria is engineered to produce IL-12. In some embodiments, the engineered bacteria comprises sequence to encode IL-12 (i.e., the p35 and p40 subunits). In some embodiments, the engineered bacteria is engineered to over-express IL-12, for example, operatively linked to a strong promoter and/or comprising more than one copy of the IL-12 gene sequence. In some embodiments, the engineered bacteria comprises sequence(s) encoding two or more copies of IL-12, e.g., two, three, four, five, six or more copies of IL-12 gene. In some embodiments, the engineered bacteria produce one or more anti-cancer molecules that stimulate the production of IL-12. In some embodiments, the engineered bacteria comprises sequence to encode IL-12 and sequence to encode a secretory peptide(s) for the secretion of IL-12. In any of these embodiments, the genetically engineered bacteria is a tumor-targeting bacterium. In some embodiments, the genetically engineered bacterium expresses IL-12 and/or expresses secretory peptides under the control of a promoter that is activated by low-oxygen conditions. In some embodiments, the genetically engineered bacterium is a tumor-targeting bacterium that expresses IL-12, and/or expresses secretory peptide(s) under the control of a promoter that is activated by low-oxygen conditions. In certain embodiments, the genetically engineered bacteria express L-12 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-12 and/or expresses secretory peptide(s), under the control of a cancer-specific promoter, a tissue-specific promoter, or a constitutive promoter, such as any of the promoters described herein.

In some embodiments, the genetically engineered bacteria comprise a gene sequence in which two interleukin-12 monomer subunits (IL-12A (p35) and IL-12B (p40)) is covalently linked by a linker. In some embodiments, the linker is a serine glycine rich linker. In one embodiment, the gene sequence encodes construct in which a 15 amino acid linker of 'GGGGSGGGGSGGGGS' (SEQ ID NO: 1247) is inserted between two monomer subunits (IL-12A (p35) and IL-12B (p40) to produce a forced dimer human IL-12 (diIL-12) fusion protein. In some embodiments, the gene sequence is codon optimized for expression, e.g., for expression in E. coli. In any of the embodiments, in which the genetically engineered bacteria comprise a gene sequence for the expression of IL-12, in which the two subunits are linked, the gene sequence may further comprise a secretion tag. The secretion tag includes any of the secretion tags described herein or known in the art. Non-limiting examples include OmpF, cvaC, TorA, fdnG, dmsA, PelB, HlyA, Adhesin (ECOLIN_19880), DsbA (ECOLIN_21525), GltI (ECOLIN_03430), GspD (ECOLIN_16495), HdeB (ECOLIN_19410), MalE (ECOLIN_22540), OppA (ECOLIN_07295), PelB, PhoA (ECOLIN_02255), PpiA (ECOLIN_18620), TolB, tort, OmpA, PelB, mglB, and lamB Secretion Tags.

In some embodiments, the genetically engineered bacteria comprise a gene sequence encoding a IL-12 (p35) subunit linked to the IL-12 (p40) subunit having at least about 80% identity with a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194. In some embodiments, the genetically engineered bacteria comprise a gene sequence encoding a IL-12 (p35) subunit linked to the IL-12 (p40) subunit that has about having at least about 90% identity with a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194. In some embodiments, the genetically engineered bacteria comprise a gene sequence encoding a IL-12 (p35) subunit linked to the IL-12 (p40) subunit that has about having at least about 95% identity with a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194. In some embodiments, the genetically engineered bacteria comprise a gene sequence encoding a IL-12 (p35) subunit linked to the IL-12 (p40) subunit that has about 80%, 81%, 82%, 83%, 84%, 85%, 86%, 87%, 88%, 89%, 90%, 91%, 92%, 93%, 94%, 95%, 96%, 97%, 98%, or 99% identity to a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194, or a functional fragment thereof. In another embodiment, the IL-12 (p35) subunit linked to the IL-12 (p40) subunit comprises a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194. In yet another embodiment, the IL-12 (p35) subunit linked to the IL-12 (p40) subunit expressed by the genetically engineered bacteria consists of a sequence selected from SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1191, SEQ ID NO: 1192, SEQ ID NO: 1193, and SEQ ID NO: 1194. In any of these embodiments wherein the genetically engineered bacteria encode IL-12 (p35) subunit linked to the IL-12 (p40) subunit, one or more of the sequences encoding a Tag, such as V5, FLAG or His Tags, are removed. In other embodiments, the secretion tag is removed and replaced by a different secretion tag.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more IL-12 than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more IL-12 than unmodified bacteria of the same bacterial subtype under the same conditions. In yet another embodiment, the genetically engineered bacteria produce at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IL-12 than unmodified bacteria of the same bacterial subtype under the same conditions.

In any of these embodiments, the genetically engineered bacteria produce at least about 5-10, 10-20, 20-30, 30-40, 40-50, 50-60, 60-70, 80-90, 90-100, 100-150, 150-200, 200-250, 250-300, 300-350, 350-400 pg/ml of media, e.g., after 4 hours of induction. In one embodiment, the genetically engineered bacteria produce at least about 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490 or 500, pg/ml of media, e.g., after 4 hours of induction.

In any of these embodiments, the bacteria genetically engineered to produce IL-12 secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45%

45% to 50%, 50% to 55%, 55% to 60%, 60% to 65%, 65% to 70% to 80%, 80% to 90%, or 90% to 100% more IL-12 than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more IL-12 than unmodified bacteria of the same bacterial subtype under the same conditions. In yet another embodiment, the genetically engineered bacteria secrete at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IL-12 than unmodified bacteria of the same bacterial subtype under the same conditions.

In some embodiments, the bacteria genetically engineered to secrete IL-12 are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete IL-12 are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete IL-12 are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IL-12 are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to IL-12 are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IL-12 are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In any of these embodiments, the genetically engineered bacteria is a tumor-targeting bacterium. In some embodiments, the genetically engineered bacterium expresses IL-15 and/or expresses secretory peptides under the control of a promoter that is activated by low-oxygen conditions. In some embodiments, the genetically engineered bacterium is a tumor-targeting bacterium that expresses IL-15, and/or expresses secretory peptide(s) under the control of a promoter that is activated by low-oxygen conditions. In certain embodiments, the genetically engineered bacteria express IL-15 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-15 and/or expresses secretory peptide(s), under the control of a cancer-specific promoter, a tissue-specific promoter, or a constitutive promoter, such as any of the promoters described herein.

In some embodiments, the genetically engineered microorganisms are capable of expressing any one or more of the described IL-15 circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding IL-15 are controlled by a promoter inducible by such conditions and/or inducers. In some embodiments, the gene sequences(s) encoding IL-15 are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding IL-12 are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

IL-15 displays pleiotropic functions in homeostasis of both innate and adaptive immune system and binds to IL-15 receptor, a heterotrimeric receptor composed of three subunits. The alpha subunit is specific for IL-15, while beta (CD122) and gamma (CD132) subunits are shared with the IL-2 receptor, and allow shared signaling through the JAJ/STAT pathways.

IL-15 is produced by several cell types, including dendritic cells, monocytes and macrophages. Co-expression of IL-15Ra and IL-15 produced in the same cell, allows intracellular binding of IL-15 to IL-15Ra, which is then shuttled to the cell surface as a complex. Once on the cell surface, then, the IL-15Ra of these cells is able to trans-present IL-15 to IL-15Rβ-γc of CD8 T cells, NK cells, and NK-T cells, which do not express IL-15, inducing the formation of the so-called immunological synapse. Murine and human IL-15Ra, exists both in membrane bound, and also in a soluble form. Soluble IL-15Rα (sIL-15Rα) is constitutively generated from the transmembrane receptor through proteolytic cleavage.

IL-15 is critical for lymphoid development and peripheral maintenance of innate immune cells and immunological memory of T cells, in particular natural killer (NK) and CD8+ T cell populations. In contrast to IL-2, IL-15 does not promote the maintenance of Tregs and furthermore, IL-15 has been shown to protect effector T cells from IL-2—mediated activation-induced cell death.

Consequently, delivery of IL-15 is considered a promising strategy for long-term anti-tumor immunity. In a first-in-human clinical trial of recombinant human IL-15, a 10-fold expansion of NK cells and significantly increased the proliferation of γδT cells and CD8+ T cells was observed upon treatment. In addition, IL-15 superagonists containing cytokine-receptor fusion complexes have been developed and are evaluated to increase the length of the response. These include the L-15 N72D superagonist/IL-15RαSushi-Fc fusion complex (IL-15SA/IL-15RαSu-Fc; ALT-803) (Kim et al., 2016 IL-15 superagonist/IL-15RαSushi-Fc fusion complex (IL-15SA/IL-15RαSu-Fc; ALT-803) markedly enhances specific subpopulations of NK and memory CD8+ T cells, and mediates potent anti-tumor activity against murine breast and colon carcinomas).

Thus, in some embodiments, the engineered bacteria is engineered to produce IL-15.

The biological activity of IL-15 is greatly improved by pre-associating IL-15 with a fusion protein IL-15Rα-Fc or by direct fusion with the sushi domain of IL-15Rα (hyper-IL-15) to mimic trans-presentation of IL-15 by cell-associated IL-15Rα. IL-15, either administrated alone or as a complex with IL-15Rα, exhibits potent antitumor activities in animal models (Cheng et al., Immunotherapy of metastatic and autochthonous liver cancer with IL-15/IL-15Ra fusion protein; Oncoimmunology. 2014; 3(11): e963409, and references therein).

In some embodiments, the engineered bacteria comprises sequence to encode IL-15. In some embodiments, the engineered bacteria is engineered to over-express IL-15, for example, operatively linked to a strong promoter and/or comprising more than one copy of the IL-15 gene sequence. In some embodiments, the engineered bacteria comprises sequence(s) encoding two or more copies of IL-15 gene, e.g., two, three, four, five, six or more copies of IL-15 gene. In some embodiments, the engineered bacteria produce one or more anti-cancer molecules that stimulate the production of IL-15. In some embodiments, the engineered bacteria comprises sequence to encode IL-15Ra. In some embodiments, the engineered bacteria comprises sequence to encode IL-15 and sequence to encode IL-15Ra. In some embodiments, the engineered bacteria comprises sequence to encode a fusion polypeptide comprising IL-15 and IL-15Ra. In some embodiments, the engineered bacteria comprises sequence(s) to encode IL-15 and sequence to encode a secretory peptide(s) for the secretion of IL-15. Exemplary secretion tags include but are not limited to OmpF, cvaC, TorA, fdnG, dmsA, PelB, HlyA, Adhesin (ECOLIN_19880), DsbA (ECOLIN_21525), GltI (ECOLIN_03430), GspD (ECOLIN_16495), HdeB (ECOLIN_19410), MalE (ECOLIN_22540), OppA (ECOLIN_07295), PelB, PhoA (ECOLIN_02255), PpiA (ECOLIN_18620), TolB, tort, OmpA, PelB, mglB, and lamB Secretion Tags.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more IL-15 or IL-15/IL-15Rα fusion protein than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more IL-15 or IL-15/IL-15Rα fusion protein than unmodified bacteria of the same bacterial subtype under the same conditions. In yet another embodiment, the genetically engineered bacteria produce at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IL-15 or IL-15/IL-15Rα fusion protein than unmodified bacteria of the same bacterial subtype under the same conditions.

In any of these embodiments, the bacteria genetically engineered to produce IL-15 or IL-15/IL-15Rα fusion protein secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more IL-15 or IL-15/IL-15Rα fusion protein than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more IL-15 or IL-15/IL-15Rα fusion protein than unmodified bacteria of the same bacterial subtype under the same conditions. In yet another embodiment, the genetically engineered bacteria secrete at least about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IL-15 or IL-15/IL-15Rα fusion protein than unmodified bacteria of the same bacterial subtype under the same conditions.

In some embodiments, the bacteria genetically engineered to secrete IL-15 or IL-15/IL-15Rα fusion protein are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete IL-15 or IL-15/IL-15Rα fusion protein are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete IL-15 or IL-15/IL-15Rα fusion protein are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IL-15 or IL-15/IL-15Rα fusion protein are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IL-15 or IL-15/IL-15Rα fusion protein are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IL-15 or IL-15/IL-15Rα fusion protein are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to produce IL-15 or IL-15/IL-15Rα fusion protein are capable of promoting expansion of NK cells by at least about 10%, 20%, 25%, 30%, 40%, 50%, 60%, 70%, 75%, 80%, 85%, 90%, 95%, or more as compared to an unmodified bacteria of the same subtype under the same conditions. In yet another embodiment, the genetically engineered bacteria promote the expansion of NK cells to at least 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria promote the expansion of NK cells to a at least three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than bacteria of the same bacterial subtype under the same conditions.

In some embodiments, the bacteria genetically engineered to produce IL-15 or IL-15/IL-15Rα fusion protein are capable of increasing the proliferation of γδT cells and/or CD8+ T cells by at least about 10%, 20%, 25%, 30%, 40%, 50%, 60%, 70%, 75%, 80%, 85%, 90%, 95%, or greater extent as compared to an unmodified bacteria of the same subtype under the same conditions. In yet another embodiment, the genetically engineered bacteria increase the proliferation of γδT cells and/or CD8+ T cells by at least 1.0-1.2-fold, 1.2-1.4-fold, 1.4-1.6-fold, 1.6-1.8-fold, 1.8-2-fold, or two-fold greater extent than unmodified bacteria of the same bacterial subtype under the same conditions. In yet another embodiment, the genetically engineered bacteria increasing the proliferation of γδT cells and/or CD8+ T cells at least three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold greater extent than unmodified bacteria of the same bacterial subtype under the same conditions.

In some embodiments, the bacteria genetically engineered to produce IL-15 or IL-15/IL-15Rα fusion protein are capable of binding to IL-15 or IL-15/IL-15Rα fusion protein receptor by at least about 10%, 20%, 25%, 30%, 40%, 50%, 60%, 70%, 75%, 80%, 85%, 90%, 95%, or greater affinity as compared to an unmodified bacteria of the same subtype under the same conditions. In yet another embodiment, the genetically engineered bacteria bind to IL-15 or IL-15/IL-15Rα fusion protein receptor with at least 1.0-1.2-fold, 1.2-1.4-fold, 1.4-1.6-fold, 1.6-1.8-fold, 1.8-2-fold, or two-fold greater affinity than unmodified bacteria of the same bacterial subtype under the same conditions. In yet another embodiment, the genetically engineered bacteria are capable of binding to IL-15 or IL-15/IL-15Rα fusion protein receptor with at least three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold or greater affinity than unmodified bacteria of the same bacterial subtype under the same conditions.

In some embodiments, the genetically engineered bacteria comprising one or more genes encoding IL-15 for secretion are capable of inducing STAT5 phosphorylation, e.g., in CD3+IL15RAalpha+ T-cells. In some embodiments, the bacteria genetically engineered to produce IL-15 or IL-15/IL-15Rα fusion protein are capable of inducing STAT5 phosphorylation by at least about 10%, 20%, 25%, 30%, 40%, 50%, 60%, 70%, 75%, 80%, 85%, 90%, 95%, or more to higher levels as compared to an unmodified bacteria of the same subtype under the same conditions. In yet another embodiment, the genetically engineered bacteria induce STAT5 phosphorylation with at least 1.0-1.2-fold, 1.2-1.4-fold, 1.4-1.6-fold, 1.6-1.8-fold, 1.8-2-fold, or two-fold or more to higher levels than unmodified bacteria of the same bacterial subtype under the same conditions. In yet another embodiment, the genetically engineered bacteria induce STAT5 phosphorylation with at least three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold or more higher levels than unmodified bacteria of the same bacterial subtype under the same conditions. In one embodiment, the IL-15 secreting strain induce STAT5 phosphorylation comparable to that of rhIL15 at the same amount under the same conditions.

In some embodiments, the genetically engineered bacteria comprising one or more genes encoding IL-15 for secretion are capable of inducing STAT3 phosphorylation, e.g., in CD3+IL15RAalpha+ T-cells. In some embodiments, the genetically engineered bacteria comprising one or more genes encoding IL-15 for secretion are capable of inducing STAT3 phosphorylation, e.g., in CD3+IL15RAalpha+ T-cells. In some embodiments, the bacteria genetically engineered to produce IL-15 or IL-15/IL-15Rα fusion protein are capable of inducing STAT3 phosphorylation by at least about 10%, 20%, 25%, 30%, 40%, 50%, 60%, 70%, 75%, 80%, 85%, 90%, 95%, or more to higher levels as compared to an unmodified bacteria of the same subtype under the same conditions. In yet another embodiment, the genetically engineered bacteria induce STAT3 phosphorylation with at least 1.0-1.2-fold, 1.2-1.4-fold, 1.4-1.6-fold, 1.6-1.8-fold, 1.8-2-fold, or two-fold or more to higher levels than unmodified bacteria of the same bacterial subtype under the same conditions. In yet another embodiment, the genetically engineered bacteria induce STAT3 phosphorylation with at least three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold or more higher levels than unmodified bacteria of the same bacterial subtype under the same conditions. In one embodiment, the IL-15 secreting strain induce STAT3 phosphorylation comparable to that of rhIL15 at the same amount under the same conditions.

In some embodiments, the genetically engineered bacteria comprise gene sequence(s) encoding one or more IL-15, IL-Ralpha, Linker, and IL-15-IL15Ralpha fusion polypeptide(s) having at least about 80% identity with a sequence selected from SEQ ID NO: 1133, SEQ ID NO: 1134, SEQ ID NO: 1135, SEQ ID NO: 1136. In some embodiments, the genetically engineered bacteria comprise gene sequence(s) encoding one or more IL-15, IL-Ralpha, Linker, and IL-15-IL15Ralpha fusion polypeptide(s) having at least about 90% identity with a sequence selected from SEQ ID NO: 1133, SEQ ID NO: 1134, SEQ ID NO: 1135, SEQ ID NO: 1136. In some embodiments, the genetically engineered bacteria comprise gene sequence(s) encoding one or more IL-15, IL-Ralpha, Linker, and IL-15-IL15Ralpha fusion polypeptide(s) having at least about 90% identity with a sequence selected from SEQ ID NO: 1133, SEQ ID NO: 1134, SEQ ID NO: 1135, SEQ ID NO: 1136.

In some embodiments, genetically engineered bacteria comprise a gene sequence encoding a polypeptide that is at least about 80%, at least about 85%, at least about 90%, at least about 95%, or at least about 99% identity to one or more polypeptide(s) selected from SEQ ID NO: 1133, SEQ ID NO: 1134, SEQ ID NO: 1135, SEQ ID NO: 1136 or a functional fragment thereof. In other specific embodiments, the polypeptide consists of one or more polypeptide(s) selected from SEQ ID NO: 1133, SEQ ID NO: 1134, SEQ ID NO: 1135, SEQ ID NO: 1136.

In some embodiments, the genetically engineered bacteria comprise a gene sequence encoding IL-15, IL-Ralpha, Linker, and IL-15-IL15Ralpha fusion protein, or a fragment or functional variant thereof. In one embodiment, the gene sequence encoding IL-15 or IL-15 fusion protein has at least about 90% identity with a sequence selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344. In one embodiment, the gene sequence encoding IL-15 or IL-15 fusion protein has at least about 80% identity with a sequence selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344. In one embodiment, the gene sequence encoding IL-15 or IL-15 fusion protein has at least about 95% identity with a sequence selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344. In certain embodiments, the IL-15, IL-Ralpha, Linker, and IL-15-IL15Ralpha fusion protein sequence has at least about 80%, 85%, 86%, 87%, 88%, 89%, 90%, 91%, 92%, 93%, 94%, 95%, 96%, 97%, 98%, or 99% identity with one or more polynucleotides selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344 or functional fragments thereof. In some specific embodiments, the gene sequence comprises one or more polynucleotides selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344. In other specific embodiments, the gene sequence consists of one or more polynucleotides selected from SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344.

In some embodiments, the genetically engineered bacteria comprise a gene sequence encoding IL-15 or IL-15 fusion protein, or a fragment or functional variant thereof. In one embodiment, the gene sequence encoding IL-15 or IL-15 fusion protein has at least about 80% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In another embodiment, the gene sequence encoding IL-15 or IL-15 fusion protein has at least about 85% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In one embodiment, the gene sequence encoding IL-15 or IL-15 fusion protein has at least about 90% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In one embodiment, the gene sequence IL-15 or IL-15 fusion protein has at least about 95% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In another embodiment, the gene sequence encoding IL-15 or IL-15 fusion protein has at least about 96%, 97%, 98%, or 99% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. Accordingly, in one embodiment, the gene sequence encoding IL-15 or IL-15 fusion protein has at least about 80%, 81%, 82%, 83%, 84%, 85%, 86%, 87%, 88%, 89%, 90%, 91%, 92%, 93%, 94%, 95%, 96%, 97%, 98%, or 99% identity with a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In another embodiment, the gene sequence encoding IL-15 or IL-15 fusion protein comprises a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In yet another embodiment, the gene sequence encoding IL-15 or IL-15 fusion protein consists of a sequence selected from SEQ ID NO: 1345, SEQ ID NO: 1200, SEQ ID NO: 1201, SEQ ID NO: 1202, SEQ ID NO: 1203, SEQ ID NO: 1204, and SEQ ID NO: 1199. In any of these embodiments wherein the genetically engineered bacteria encode IL-15 or IL-15 fusion protein, one or more of the sequences encoding a Tag are removed.

In some embodiments, the genetically engineered bacteria comprise a gene sequence encoding a IL-15 or IL-15 fusion protein described herein having at least about 80% identity with a sequence selected from SEQ ID NO: 1195, SEQ ID NO: 1196, SEQ ID NO: 1197, and SEQ ID NO: 1198. In some embodiments, the genetically engineered bacteria comprise a gene sequence encoding a IL-15 or IL-15 fusion protein that has about having at least about 90% identity with a sequence selected from SEQ ID NO: 1195, SEQ ID NO: 1196, SEQ ID NO: 1197, and SEQ ID NO: 1198. In some embodiments, the genetically engineered bacteria comprise a gene sequence encoding a IL-15 or IL-15 fusion protein that has about having at least about 95% identity with a sequence selected from SEQ ID NO: 1195, SEQ ID NO: 1196, SEQ ID NO: 1197, and SEQ ID NO: 1198. In some embodiments, the genetically engineered bacteria comprise a gene sequence encoding a IL-15 or IL-15 fusion protein that has about 80%, 81%, 82%, 83%, 84%, 85%, 86%, 87%, 88%, 89%, 90%, 91%, 92%, 93%, 94%, 95%, 96%, 97%, 98%, or 99% identity to a sequence selected from SEQ ID NO: 1195, SEQ ID NO: 1196, SEQ ID NO: 1197, and SEQ ID NO: 1198, or a functional fragment thereof. In another embodiment, the IL-15 or IL-15 fusion protein comprises a sequence selected from SEQ ID NO: 1195, SEQ ID NO: 1196, SEQ ID NO: 1197, and SEQ ID NO: 1198. In yet another embodiment, the IL-15 or IL-15 fusion protein expressed by the genetically engineered bacteria consists of a sequence selected from SEQ ID NO: 1195, SEQ ID NO: 1196, SEQ ID NO: 1197, and SEQ ID NO: 1198. In any of these embodiments wherein the genetically engineered bacteria encode IL-15 or IL-15 fusion protein, the secretion tag may be removed and replaced by a different secretion tag.

In any of these embodiments, the genetically engineered bacteria is a tumor-targeting bacterium. In some embodiments, the genetically engineered bacterium expresses IL-15 and/or expresses secretory peptides under the control of a promoter that is activated by low-oxygen conditions. In some embodiments, the genetically engineered bacterium is a tumor-targeting bacterium that expresses IL-15, and/or expresses secretory peptide(s) under the control of a promoter that is activated by low-oxygen conditions. In certain embodiments, the genetically engineered bacteria express IL-15 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-15 and/or expresses secretory peptide(s), under the control of a cancer-specific promoter, a tissue-specific promoter, or a constitutive promoter, such as any of the promoters described herein.

In some embodiments, the genetically engineered microorganisms are capable of expressing any one or more of the described IL-15 circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding IL-15 are controlled by a promoter inducible by such conditions and/or inducers. In some embodiments, the gene sequences(s) encoding IL-15 are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding IL-15 are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In some embodiments, the IL-15 is secreted. In some embodiments, the genetically engineered bacteria comprising the gene sequence(s) encoding IL-15 comprise a secretion tag selected from PhoA, OmpF, cvaC, TorA, FdnG, DmsA, and PelB. In some embodiments, the secretion tag is PhoA. In some embodiments, the genetically engineered bacteria further comprise one or more deletions in an outer membrane protein selected from lpp, nlP, tolA, and PAL. In some embodiments, the deleted or mutated outer membrane protein is PAL. In some embodiments, the genetically engineered bacteria comprising gene sequence(s) for the production of IL-15 further comprise gene sequence(s) encoding CXCL10. In some embodiments, CXCL10 is secreted. In some embodiments, the gene sequence(s) encoding CXCL10 comprise a secretion tag selected from PhoA, OmpF, cvaC, TorA, FdnG, DmsA, and PelB. In some embodiments, the secretion tag is PhoA. In some embodiments, the genetically engineered bacteria further comprise one or more deletions in an outer membrane protein selected from lpp, nlP, tolA, and PAL. In some embodiments, the deleted or mutated outer membrane protein is PAL.

In any of these embodiments, in which the bacteria encode IL-15 and/or CXCL10, the bacterium may further comprise gene sequence(s) encoding kynureninase. In some embodiments, the kynureninase is from *Pseudomonas fluorescens*. In some embodiments, the bacteria further comprise a mutation or deletion in trpE. In any of these embodiments, the bacteria may further comprise gene sequence(s) for the production of tryptophan. In some embodiments, the gene sequences for the production of tryptophan are selected from trpE, trpD, trpC, trpB, trpA, aroG, and SerA. In some embodiments, aroG is a feedback resistant form of aroG (aroGfbr). In some embodiments, trpE is a feedback resistant form of trpE (trpEfbr). In some embodiments, the genetically engineered bacteria further comprise a mutation or deletion in trpR. In some embodiments, the genetically engineered bacteria further comprise a mutation or deletion in tnaA.

Interferon gamma (IFNγ or type II interferon), is a cytokine that is critical for innate and adaptive immunity against viral, some bacterial and protozoal infections. IFNγ activates macrophages and induces Class II major histocompatibility complex (MHC) molecule expression. IFNγ can inhibit viral replication and has immunostimulatory and immunomodulatory effects in the immune system. IFNγ is produced predominantly by natural killer (NK) and natural killer T (NKT) cells as part of the innate immune response, and by CD4 Th1 and CD8 cytotoxic T lymphocyte (CTL) effector T cells. Once antigen-specific immunity develops IFNγ is secreted by T helper cells (specifically, Th1 cells), cytotoxic T cells (TC cells) and NK cells only. It has numerous immunostimulatory effects and plays several different roles in the immune system, including the promotion of NK cell activity, increased antigen presentation and lysosome activity of macrophages, activation of inducible Nitric Oxide Synthase iNOS, production of certain IgGs from activated plasma B cells, promotion of Th1 differentiation that leads to cellular immunity. It can also cause normal cells to increase expression of class I MHC molecules as well as class II MHC on antigen-presenting cells, promote adhesion and binding relating to leukocyte migration, and is involved in granuloma formation through the activation of macrophages so that they become more powerful in killing intracellular organisms.

Thus, in some embodiments, the engineered bacteria is engineered to produce IFN-γ. In some embodiments, the engineered bacteria comprises sequence to encode IFN-γ. In some embodiments, the engineered bacteria is engineered to over-express IFN-γ, for example, operatively linked to a strong promoter and/or comprising more than one copy of the IFN-γ gene sequence. In some embodiments, the engineered bacteria comprises sequence(s) encoding two or more copies of IFN-γ gene, e.g., two, three, four, five, six or more copies of IFN-γ gene. In any of these embodiments, the genetically engineered bacteria is a tumor-targeting bacterium. In some embodiments, the genetically engineered bacterium expresses IFN-γ and/or expresses secretory peptides under the control of a promoter that is activated by low-oxygen conditions. In some embodiments, the genetically engineered bacterium is a tumor-targeting bacterium that expresses IFN-γ, and/or expresses secretory peptide(s) under the control of a promoter that is activated by low-oxygen conditions. In certain embodiments, the genetically engineered bacteria express IFN-γ and/or secretory peptide(s), under the control of a promoter that is activated by hypoxic conditions, or by inflammatory conditions, such as any of the promoters activated by said conditions and described herein. In some embodiments, the genetically engineered bacteria expresses IFN-γ and/or expresses secretory peptide(s), under the control of a cancer-specific promoter, a tissue-specific promoter, or a constitutive promoter, such as any of the promoters described herein.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more IFN-gamma than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more IFN-gamma than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IFN-gamma than unmodified bacteria of the same bacterial subtype under the same conditions.

In any of these embodiments, the bacteria genetically engineered to produce IFN-gamma secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more IFN-gamma than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more IFN-gamma than unmodified bacteria of the same bacterial subtype under the same conditions. In yet another embodiment, the genetically engineered bacteria secrete three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more IFN-gamma than unmodified bacteria of the same bacterial subtype under the same conditions.

In some embodiments, the bacteria genetically engineered to secrete IFN-gamma are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria comprising one or more genes encoding IFN-gamma induce STAT1 phosphorylation in macrophage cell lines. In any of these embodiments, the bacteria genetically engineered to produce IFN-gamma induce STAT1 phosphorylation 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% or greater levels than unmodified bacteria of the same bacterial subtype under the same conditions. In yet another embodiment, the genetically engineered bacteria induce STAT1 phosphorylation 1.0-1.2-fold, 1.2-1.4-fold, 1.4-1.6-fold, 1.6-1.8-fold, 1.8-2-fold, or two-fold or greater levels than unmodified bacteria of the same bacterial subtype under the same conditions. In yet another embodiment, the genetically engineered bacteria induce STAT1 phosphorylation three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or greater levels than unmodified bacteria of the same bacterial subtype under the same conditions.

In one specific embodiment, the bacteria are capable of increasing IFNgamma production in the tumor by 0.1, 0.2, 0.3 ng per gram of tumor relative to same bacteria unmodified bacteria of the same bacterial subtype under the same conditions. In one specific embodiment, the bacteria are capable of increasing IFNgamma production about 5, 10, or 15 fold relative to same bacteria unmodified bacteria of the same bacterial subtype under the same conditions.

In some embodiments, the bacteria genetically engineered to secrete IFN-gamma are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to secrete IFN-gamma are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IFN-gamma are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IFN-gamma are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce IFN-gamma are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered microorganisms are capable of expressing any one or more of the described IFN-gamma circuits in low-oxygen conditions, and/or in the presence of cancer and/or in the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding IFN-gamma are controlled by a promoter inducible by such conditions and/or inducers. In some embodiments, the gene sequences(s) encoding IFN-gamma are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described genes sequences encoding IFN-gamma are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Interleukin-18 (IL18, also known as interferon-gamma inducing factor) is a proinflammatory cytokine that belongs to the IL-1 superfamily and is produced by macrophages and other cells. IL-18 binds to the interleukin-18 receptor, and together with IL-12 it induces cell-mediated immunity following infection with microbial products like lipopolysaccharide (LPS). Upon stimulation with IL-18, natural killer (NK) cells and certain T helper type 1 cells release interferon-γ (IFN-γ) or type II interferon, which plays a role in activating the macrophages and other immune cells. IL-18 is also able to induce severe inflammatory reactions.

Thus, in some embodiments, the engineered bacteria is engineered to produce IL-18. In some embodiments, the engineered bacteria comprises sequence to encode IL-18. In some embodiments, the engineered bacteria is engineered to over-express IL-18, for example, operatively linked to a strong promoter and/or comprising more than one copy of the IL-18 gene sequence. In some embodiments, the engineered bacteria comprises sequence(s) encoding two or more copies of IL-18 gene, e.g., two, three, four, five, six or more copies of IL-18 gene. In any of these embodiments, the genetically engineered bacteria is a tumor-targeting bacterium. In some embodiments, the genetically engineered bacterium expresses IL-18 and/or expresses secretory peptides under the control of a promoter that is activated by low-oxygen conditions. In some embodiments, the genetically engineered bacterium is a tumor-targeting bacterium that expresses IL-18, and/or expresses secretory peptide(s) under the control of a promoter that is activated by low-oxygen conditions. In certain embodiments, the genetically engineered bacteria express IL-18 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-18 and/or expresses secretory peptide(s), under the control of a cancer-specific promoter, a tissue-specific promoter, or a constitutive promoter, such as any of the promoters described herein.

Interleukin-2 (IL-2) is cytokine that regulates the activities of white blood cells (leukocytes, often lymphocytes). IL-2 is part of the body's natural response to microbial infection, and in discriminating between foreign ("non-self") and "self". IL-2 mediates its effects by binding to IL-2 receptors, which are expressed by lymphocytes. IL-2 is a member of a cytokine family, which also includes IL-4, IL-7, IL-9, IL-15 and IL-21. IL-2 signals through the IL-2 receptor, a complex consisting of alpha, beta and gamma sub-units. The gamma subunit is shared by all members of this family of cytokine receptors. IL-2 promotes the differentiation of T cells into effector T cells and into memory T cells when the initial T cell is stimulated by an antigen. Through its role in the development of T cell immunologic memory, which depends upon the expansion of the number and function of antigen-selected T cell clones, it also has a key role in cell-mediated immunity. IL-2 has been approved by the Food and Drug Administration (FDA) and in several European countries for the treatment of cancers (malignant melanoma, renal cell cancer). IL-2 is also used to treat melanoma metastases and has a high complete response rate.

Thus, in some embodiments, the engineered bacteria is engineered to produce IL-2. In some embodiments, the engineered bacteria comprises sequence to encode IL-2. In some embodiments, the engineered bacteria is engineered to over-express IL-2, for example, operatively linked to a strong promoter and/or comprising more than one copy of the IL-2 gene sequence. In some embodiments, the engineered bacteria comprises sequence(s) encoding two or more copies of IL-2 gene, e.g., two, three, four, five, six or more copies of IL-2 gene. In any of these embodiments, the genetically engineered bacteria is a tumor-targeting bacterium. In some embodiments, the genetically engineered bacterium expresses IL-2 and/or expresses secretory peptides under the control of a promoter that is activated by low-oxygen conditions. In some embodiments, the genetically engineered bacterium is a tumor-targeting bacterium that expresses IL-2, and/or expresses secretory peptide(s) under the control of a promoter that is activated by low-oxygen conditions. In certain embodiments, the genetically engineered bacteria express IL-2 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-2 and/or expresses secretory peptide(s), under the control of a cancer-specific promoter, a tissue-specific promoter, or a constitutive promoter, such as any of the promoters described herein.

Interleukin-21 is a cytokine that has potent regulatory effects on certain cells of the immune system, including natural killer (NK) cells and cytotoxic T cells. IL-21 induces cell division/proliferation in its these cells. IL-21 is expressed in activated human CD4+ T cells but not in most other tissues. In addition, IL-21 expression is up-regulated in Th2 and Th17 subsets of T helper cells. IL-21 is also expressed in NK T cells regulating the function of these cells. When bound to IL-21, the IL-21 receptor acts through the Jak/STAT pathway, utilizing Jak1 and Jak3 and a STAT3 homodimer to activate its target genes. IL-21 has been shown to modulate the differentiation programming of human T cells by enriching for a population of memory-type CTL with a unique CD28+CD127hi CD45RO+ phenotype with IL-2 producing capacity. IL-21 also has anti-tumor effects through continued and increased CD8+ cell response to achieve enduring tumor immunity. IL-21 has been approved for Phase 1 clinical trials in metastatic melanoma (MM) and renal cell carcinoma (RCC) patients.

Thus, in some embodiments, the engineered bacteria is engineered to produce IL-21. In some embodiments, the engineered bacteria comprises sequence that encodes IL-21. In some embodiments, the engineered bacteria is engineered to over-express IL-21, for example, operatively linked to a strong promoter and/or comprising more than one copy of the IL-21 gene sequence. In some embodiments, the engineered bacteria comprises sequence(s) encoding two or more copies of IL-21, e.g., two, three, four, five, six or more copies of IL-21 gene. In some embodiments, the engineered bacteria produce one or more anti-cancer molecules that stimulate the production of IL-21. In some embodiments, the engineered bacteria comprises sequence to encode IL-21 and sequence to encode a secretory peptide(s) for the secretion of 11-21. In any of these embodiments, the genetically engineered bacteria is a tumor-targeting bacterium. In some embodiments, the genetically engineered bacterium expresses IL-21 and/or expresses secretory peptides under the control of a promoter that is activated by low-oxygen conditions. In some embodiments, the genetically engineered bacterium is a tumor-targeting bacterium that expresses IL-21, and/or expresses secretory peptide(s) under the control of a promoter that is activated by low-oxygen conditions. In certain embodiments, the genetically engineered bacteria express IL-21 and/or secretory peptide(s), under the control of a promoter that is activated by hypoxic conditions, or by inflammatory conditions, such as any of the promoters activated by said conditions and described herein. In some embodiments, the genetically engineered bacteria expresses IL-21 and/or expresses secretory peptide(s), under the control of a cancer-specific promoter, a tissue-specific promoter, or a constitutive promoter, such as any of the promoters described herein.

Tumor necrosis factor (TNF) (also known as cachectin or TNF alpha) is a cytokine that can cause cytolysis of certain tumor cell lines and can stimulate cell proliferation and induce cell differentiation under certain conditions. TNF is involved in systemic inflammation and is one of the cytokines that make up the acute phase reaction. It is produced chiefly by activated macrophages, although it can be produced by many other cell types such as CD4+ lymphocytes, NK cells, neutrophils, mast cells, eosinophils, and neurons. The primary role of TNF is in the regulation of immune cells.

TNF can bind two receptors, TNFR1 (TNF receptor type 1; CD120a; p55/60) and TNFR2 (TNF receptor type 2; CD120b; p75/80). TNFR1 is expressed in most tissues, and can be fully activated by both the membrane-bound and soluble trimeric forms of TNF, whereas TNFR2 is found only in cells of the immune system, and respond to the membrane-bound form of the TNF homotrimer. Upon binding to its receptor, TNF can activate NF-κB and MAPK pathways which mediate the transcription of numerous proteins and mediate several pathways involved in cell differentiation and proliferation, including those pathways involved in the inflammatory response. TNF also regulates pathways that induce cell apoptosis.

In some embodiments, the genetically engineered bacteria are capable of producing an immune modulator that modulates dendritic cell activation. In some embodiments, the immune modulator is TNF. Thus, in some embodiments, the engineered bacteria is engineered to produce TNF. In some embodiments, the engineered bacteria comprises sequence that encodes TNF. In some embodiments, the engineered bacteria is engineered to over-express TNF, for example, operatively linked to a strong promoter and/or comprising more than one copy of the TNF gene sequence. In some embodiments, the engineered bacteria comprises sequence(s) encoding two or more copies of TNF, e.g., two, three, four, five, six or more copies of TNF gene. In some embodiments, the engineered bacteria produce one or more anti-cancer molecules that stimulate the production of TNF. In some embodiments, the engineered bacteria comprises sequence to encode TNF and sequence to encode a secretory peptide(s) for the secretion of TNF. In any of these embodiments, the genetically engineered bacteria is a tumor-targeting bacterium. In some embodiments, the genetically engineered bacterium expresses TNF and/or expresses secretory peptides under the control of a promoter that is activated by low-oxygen conditions. In some embodiments, the genetically engineered bacterium is a tumor-targeting bacterium that expresses TNF, and/or expresses secretory peptide(s) under the control of a promoter that is activated by low-oxygen conditions. In certain embodiments, the genetically engineered bacteria express TNF and/or secretory peptide(s), under the control of a promoter that is activated by hypoxic conditions, or by inflammatory conditions, such as any of the promoters activated by said conditions and described herein. In some embodiments, the genetically engineered bacteria expresses TNF and/or expresses secretory peptide(s), under the control of a cancer-specific promoter, a tissue-specific promoter, or a constitutive promoter, such as any of the promoters described herein.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more TNF than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more TNF than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more TNF than unmodified bacteria of the same bacterial subtype under the same conditions.

In any of these embodiments, the bacteria genetically engineered to produce TNF secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more TNF than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more TNF than unmodified bacteria of the same bacterial subtype under the same conditions. In yet another embodiment, the genetically engineered bacteria secrete three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more TNF than unmodified bacteria of the same bacterial subtype under the same conditions.

In some embodiments, the bacteria genetically engineered to secrete TNF are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete TNF are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete TNF are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce TNF are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In one embodiment, the genetically engineered bacteria are capable of reducing tumor volume by about 40-60%, by about 45-55%, e.g., on day 7 of a two dose treatment regimen. In one embodiment, tumor volume is about 300 mm3 upon administration of the bacteria expressing TNF, relative to about 600 mm3 upon administration of unmodified bacteria of the same subtype under the same conditions. In some embodiments, the bacteria genetically engineered to produce TNF are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce TNF are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the bacteria genetically engineered to produce TNF are capable of increasing CCR7 expression on dendritic cells and/or macrophages.

In some embodiments, the genetically engineered bacteria comprising one or more genes encoding TNFalpha for secretion are capable of activating the NFkappaB pathway, e.g., in cells with TNF receptor. In some embodiments, the genetically engineered bacteria comprising one or more genes encoding TNFalpha are capable of inducing IkappaBalpha degradation. In some embodiments, secreted TNFalpha levels secreted from the engineered bacteria causes IkappaBalpha degradation to about the same extent as recombinant TNFalpha at the same concentration under the same conditions.

In some embodiments, the genetically engineered microorganisms are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

CD40 is a costimulatory protein found on antigen presenting cells and is required for their activation. The protein receptor encoded by this gene is a member of the TNF-receptor superfamily.

In the macrophage, the primary signal for activation is IFN-γ from Th1 type CD4 T cells. The secondary signal is CD40L (CD154) on the T cell which binds CD40 on the macrophage cell surface. As a result, the macrophage expresses more CD40 and TNF receptors on its surface which helps increase the level of activation.

In some embodiments, the genetically engineered bacteria are capable of producing an immune modulator that modulates macrophage and/or dendritic cell activation. In some embodiments, the immune modulator is CD40 Ligand. Thus, in some embodiments, the engineered bacteria is engineered to produce CD40 Ligand. In some embodiments, the engineered bacteria comprises sequence that encodes CD40 Ligand. In some embodiments, the engineered bacteria is engineered to over-express CD40 Ligand, for example, operatively linked to a strong promoter and/or comprising more than one copy of the CD40 Ligand gene sequence. In some embodiments, the engineered bacteria comprises sequence(s) encoding two or more copies of CD40 Ligand, e.g., two, three, four, five, six or more copies of CD40 Ligand gene. In some embodiments, the engineered bacteria produce one or more anti-cancer molecules that stimulate the production of CD40 Ligand. In some embodiments, the engineered bacteria comprises sequence to encode CD40 Ligand and sequence to encode a secretory peptide(s) for the secretion of CD40 Ligand. In any of these embodiments, the genetically engineered bacteria is a tumor-targeting bacterium. In some embodiments, the genetically engineered bacterium expresses CD40 Ligand and/or expresses secretory peptides under the control of a promoter that is activated by low-oxygen conditions. In some embodiments, the genetically engineered bacterium is a tumor-targeting bacterium that expresses CD40 Ligand, and/or expresses secretory peptide(s) under the control of a promoter that is activated by low-oxygen conditions. In certain embodiments, the genetically engineered bacteria express CD40 Ligand and/or secretory peptide(s), under the control of a promoter that is activated by hypoxic conditions, or by inflammatory conditions, such as any of the promoters activated by said conditions and described herein. In some embodiments, the genetically engineered bacteria expresses CD40 Ligand and/or expresses secretory peptide(s), under the control of a cancer-specific promoter, a tissue-specific promoter, or a constitutive promoter, such as any of the promoters described herein.

In any of these embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CD40 ligand than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more CD40 ligand than unmodified bacteria of the same bacterial subtype under the same conditions. In yet another embodiment, the genetically engineered bacteria produce three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CD40 ligand than unmodified bacteria of the same bacterial subtype under the same conditions.

In any of these embodiments, the bacteria genetically engineered to produce CD40 ligand secrete at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more CD40 ligand than unmodified bacteria of the same bacterial subtype under the same conditions. In yet another embodiment, the genetically engineered bacteria secrete at least about 1.0-1.2-fold, 1.2-1.4-fold, 1.4-1.6-fold, 1.6-1.8-fold, 1.8-2-fold, or two-fold more CD40 ligand than unmodified bacteria of the same bacterial subtype under the same conditions. In yet another embodiment, the genetically engineered bacteria secrete three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more CD40 ligand than unmodified bacteria of the same bacterial subtype under the same conditions.

In some embodiments, the bacteria genetically engineered to secrete CD40 ligand are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CD40 ligand are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to secrete CD40 ligand are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CD40 ligand are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CD40 ligand are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CD40 ligand are capable of increasing the response rate by at least about 10%, 20%, 25%, 30%, 40%, 50%, 60%, 70%, 75%, 80%, 85%, 90%, 95%, or more as compared to an unmodified bacteria of the same subtype under the same conditions. In some embodiments, the bacteria genetically engineered to produce CD40 ligand are capable of increasing CCR7 expression on dendritic cells and/or macrophages.

In some embodiments, CCR7 is at least about 10%, 20%, 25%, 30%, 40%, 50%, 60%, 70%, 75%, 80%, 85%, 90%, 95%, 98% or more induced as compared to an unmodified bacteria of the same subtype under the same conditions. In some embodiments, CCR7 is about 1.0-1.2-fold, 1.2-1.4-fold, 1.4-1.6-fold, 1.6-1.8-fold, 1.8-2-fold, or two-fold more induced than observed with than unmodified bacteria of the same bacterial subtype under the same conditions. In yet another embodiment, the CCR7 is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more induced than observed with unmodified bacteria of the same bacterial subtype under the same conditions. In one embodiment, the levels of induced CCR7 in macrophages 25%-55%, about 30-45% greater than observed with unmodified bacteria of the same bacterial subtype under the same conditions.

In one embodiment, the levels of induced CCR7 in dendritic cells is about two fold greater than observed with unmodified bacteria of the same bacterial subtype under the same conditions.

In some embodiments, the bacteria genetically engineered to produce CD40 ligand are capable of increasing CCR7 expression on dendritic cells and/or macrophages.

In some embodiments, CD40 is at least about 10%, 20%, 25%, 30%, 40%, 50%, 60%, 70%, 75%, 80%, 85%, 90%, 95%, 98% or more induced as compared to an unmodified bacteria of the same subtype under the same conditions. In some embodiments, CD40 is about 1.0-1.2-fold, 1.2-1.4-fold, 1.4-1.6-fold, 1.6-1.8-fold, 1.8-2-fold, or two-fold more induced than observed with than unmodified bacteria of the same bacterial subtype under the same conditions. In yet another embodiment, the CD40 is about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold or more induced than observed with unmodified bacteria of the same bacterial subtype under the same conditions. In one embodiment, the levels of induced CD40 in macrophages 30-50% greater than observed with unmodified bacteria of the same bacterial subtype under the same conditions.

In one embodiment, the levels of induced CD40 in dendritic cells is about 10% greater than observed with unmodified bacteria of the same bacterial subtype under the same conditions.

Accordingly, in one embodiment, the genetically engineered bacteria encode a CD40 Ligand polypeptide that has about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 1093. In another embodiment, the polypeptide comprises SEQ ID NO: 1093. In yet another embodiment, the polypeptide expressed by the genetically engineered bacteria consists of SEQ ID NO: 1093.

In some embodiments, the genetically engineered microorganisms are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Granulocyte-macrophage colony-stimulating factor (GM-CSF), also known as colony stimulating factor 2 (CSF2), is a monomeric glycoprotein secreted by macrophages, T cells, mast cells, NK cells, endothelial cells and fibroblasts. GM-CSF is a white blood cell growth factor that functions as a cytokine, facilitating the development of the immune system and promoting defense against infections. For example, GM-CSF stimulates stem cells to produce granulocytes (neutrophils, eosinophils, and basophils) and monocytes, which monocytes exit the circulation and migrate into tissue, whereupon they mature into macrophages and dendritic cells. GM-CSF is part of the immune/inflammatory cascade, by which activation of a small number of macrophages rapidly lead to an increase in their numbers, a process which is crucial for fighting infection. GM-CSF signals via the signal transducer and activator of transcription, STAT5 or via STAT3 (which activates macrophages).

In some embodiments, the genetically engineered bacteria are capable of producing an immune modulator that modulates dendritic cell activation. In some embodiments, the immune modulator is GM-CSF. Thus, in some embodiments, the engineered bacteria is engineered to produce GM-CSF. In some embodiments, the engineered bacteria comprises sequence that encodes GM-CSF. In some embodiments, the engineered bacteria is engineered to over-express GM-CSF, for example, operatively linked to a strong promoter and/or comprising more than one copy of the GM-CSF gene sequence. In some embodiments, the engineered bacteria comprises sequence(s) encoding two or more copies of GM-CSF, e.g., two, three, four, five, six or more copies of GM-CSF gene. In some embodiments, the engineered bacteria produce one or more anti-cancer molecules that stimulate the production of GM-CSF. In some embodiments, the engineered bacteria comprises sequence to encode GM-CSF and sequence to encode a secretory peptide(s) for the secretion of GM-CSF. In any of these embodiments, the genetically engineered bacteria is a tumor-targeting bacterium. In some embodiments, the genetically engineered bacterium expresses GM-CSF and/or expresses secretory peptides under the control of a promoter that is activated by low-oxygen conditions. In some embodiments, the genetically engineered bacterium is a tumor-targeting bacterium that expresses GM-CSF, and/or expresses secretory peptide(s) under the control of a promoter that is activated by low-oxygen conditions. In certain embodiments, the genetically engineered bacteria express GM-CSF and/or secretory peptide(s), under the control of a promoter that is activated by hypoxic conditions, or by inflammatory conditions, such as any of the promoters activated by said conditions and described herein. In some embodiments, the genetically engineered bacteria expresses GM-CSF and/or expresses secretory peptide(s), under the control of a cancer-specific promoter, a tissue-specific promoter, or a constitutive promoter, such as any of the promoters described in Table 7.

TABLE 7

| Name | NP/GI Nos. | Notes |
| --- | --- | --- |
| interleukin-12 subunit alpha precursor (homo sapiens) SEQ ID NO: 152 | NP_000873.2/ GI:24430219 | Signal peptide: 1-56; Mature protein: 57-253 |
| interleukin-12 subunit beta precursor (homo sapiens) SEQ ID NO: 153 | NP_002178.2/ GI:24497438 | Signal peptide: 1-22; Mature Peptide: 23-328 |
| interleukin-15 isoform1 preproprotein (homo sapiens) SEQ ID NO: 154 | NP_000576.1/ GI:10835153 | Signal peptide: 1-29; Proprotein: 30-162; Region: 33-160; mature peptide: 49 . . . 162 |
| interleukin-15 isoform 2 preproprotein (homo sapiens) SEQ ID NO: 155 | NP_751915.1/ GI:26787986 | Protein: 1-135; Region: 6-133 |
| interleukin-2 precursor (homo sapiens) SEQ ID NO: 156 | NP_000577.2/ GI:28178861 | Signal peptide: 1-20; RegionL7-150 |
| interleukin-21 isoform 1 precursor (homo sapiens) SEQ ID NO: 157 | NP_068575.1/ GI:11141875 | Signal peptide: 1-29; Region: 42-148 |
| interleukin-21 isoform 2 precursor (homo sapiens) SEQ ID NO: 158 | NP_001193935.1/ GI:333033767 | Signal peptide: 1-29; Region: 42-146 |
| granulocyte-macrophage colony-stimulating factor precursor (homo sapiens) SEQ ID NO: 159 | NP_000749.2/ GI:27437030 | Signal peptide: 1-17; Mature peptide: 18-144; Region: 18-138 |

In some embodiments, the promoter sequence is at least about 80%, at least about 85%, at least about 90%, at least about 95%, or at least about 99% homologous to the sequence of SEQ ID NO: 152, SEQ ID NO: 153, SEQ ID NO: 154, SEQ ID NO: 155, SEQ ID NO: 156, SEQ ID NO: 157, SEQ ID NO: 158, and/or SEQ ID NO: 159.

In some embodiments, certain precursor sequences are replaced with one or more bacterial sequences, including but not limited to bacterial secretion signal sequences. In some embodiments, the polynucleotide sequence encoding the cytokines are codon-optimized for bacterial expression.

In some embodiments, certain precursor sequences are replaced with one or more mammalian sequences, including but not limited to mammalian secretion signal sequences. In some embodiments, the polynucleotide sequence encoding the cytokines are codon-optimized for mammalian expression.

In some embodiments, the genetically engineered bacteria comprise gene sequences encoding immune modulatory cytokines. In some embodiments, the genetically engineered bacteria comprise one or more gene sequences for the expression of hIL-12.

In some embodiments, genetically engineered bacteria comprise one or more gene sequences that encode a polypeptide of SEQ ID NO: 1053. In some embodiments, genetically engineered bacteria comprise one or more gene sequences that encode a polypeptide of SEQ ID NO: 1054.

In some embodiments, the genetically engineered bacteria comprise one or more gene sequences for the expression of hIL-15. In some embodiments, genetically engineered bacteria comprise one or more gene sequences that encode a polypeptide of SEQ ID NO: 1057. In some embodiments, the genetically engineered bacteria comprise one or more gene sequences for the expression of GMCSF. In some embodiments, genetically engineered bacteria comprise one or more gene sequences that encode a polypeptide of SEQ ID NO: 1058. In some embodiments, the genetically engineered bacteria comprise one or more gene sequences for the expression of TNF-alpha, e.g., the extracellular portion.

In some embodiments, genetically engineered bacteria comprise one or more gene sequences that encode a polypeptide of SEQ ID NO: 1059. In some embodiments, the genetically engineered bacteria comprise one or more gene sequences for the expression of IFN-gamma. In some embodiments, genetically engineered bacteria comprise one or more gene sequences that encode a polypeptide of SEQ ID NO: 1060. In some embodiments, the genetically engineered bacteria comprise one or more gene sequences for the expression of CXCL10. In some embodiments, genetically engineered bacteria comprise one or more gene sequences that encode a polypeptide of SEQ ID NO: 1061.

In some embodiments, the genetically engineered bacteria comprise one or more gene sequences for the expression of CXCL9. In some embodiments, genetically engineered bacteria comprise one or more gene sequences that encode a polypeptide of SEQ ID NO: 1062. In some embodiments, genetically engineered bacteria comprise a nucleic acid sequence that encodes a polypeptide that is at least about 80%, at least about 85%, at least about 90%, at least about 95%, or at least about 99% homologous to SEQ ID NO: 1053, SEQ ID NO: 1054, SEQ ID NO: 1055, SEQ ID NO: 1056, SEQ ID NO: 1057, SEQ ID NO: 1058, SEQ ID NO: 1059, SEQ ID NO: 1060, SEQ ID NO: 1061 SEQ, and ID NO: 1062. In some embodiments, genetically engineered bacteria comprise a nucleic acid sequence that encodes a polypeptide that comprise a sequence selected from SEQ ID NO: 1053, SEQ ID NO: 1054, SEQ ID NO: 1055, SEQ ID NO: 1056, SEQ ID NO: 1057, SEQ ID NO: 1058, SEQ ID NO: 1059, SEQ ID NO: 1060, SEQ ID NO: 1061 SEQ, and ID NO: 1062. In some embodiments, genetically engineered bacteria comprise a nucleic acid sequence that encodes a polypeptide that consists of a sequence selected from SEQ ID NO: 1053, SEQ ID NO: 1054, SEQ ID NO: 1055, SEQ ID NO: 1056, SEQ ID NO: 1057, SEQ ID NO: 1058, SEQ ID NO: 1059, SEQ ID NO: 1060, SEQ ID NO: 1061 SEQ, and ID NO: 1062.

In some embodiments, the genetically engineered bacteria comprise a gene sequence that but for the redundancy of the genetic code encodes the same polypeptide as SEQ ID NO: 1063. In some embodiments, the genetically engineered bacteria comprise SEQ ID NO: 1063. In some embodiments, the genetically engineered bacteria comprise a gene sequence that but for the redundancy of the genetic code encodes the same polypeptide as SEQ ID NO: 1064. In some embodiments, the genetically engineered bacteria comprise a gene sequence SEQ ID NO: 1064. In some embodiments, the genetically engineered bacteria comprise a gene sequence that but for the redundancy of the genetic code encodes the same polypeptide as SEQ ID NO: 1067 In some embodiments, the genetically engineered bacteria comprise SEQ ID NO: 1067. In some embodiments, the genetically engineered bacteria comprise a gene sequence that but for the redundancy of the genetic code encodes the same polypeptide as SEQ ID NO: 1068 In some embodiments, the genetically engineered bacteria comprise SEQ ID NO: 1068. In some embodiments, the genetically engineered bacteria comprise a gene sequence that but for the redundancy of the genetic code encodes the same polypeptide as SEQ ID NO: 1069 In some embodiments, the genetically engineered bacteria comprise SEQ ID NO: 1069. In some embodiments, the genetically engineered bacteria comprise a gene sequence In some embodiments, the genetically engineered bacteria comprise a gene sequence that but for the redundancy of the genetic code encodes the same polypeptide as SEQ ID NO: 1070. In some embodiments, the genetically engineered bacteria comprise SEQ ID NO: 1070 In some embodiments, the genetically engineered bacteria comprise a gene sequence that but for the redundancy of the genetic code encodes the same polypeptide as SEQ ID NO: 1071 In some embodiments, the genetically engineered bacteria comprise SEQ ID NO: 1071. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 1063, SEQ ID NO: 1064, SEQ ID NO: 1067, SEQ ID NO: 1068, SEQ ID NO: 1069, SEQ ID NO: 1070, and/or SEQ ID NO: 1071. In some embodiments, genetically engineered bacteria comprise a nucleic acid sequence comprising a sequence selected from SEQ ID NO: 1063, SEQ ID NO: 1064, SEQ ID NO: 1067, SEQ ID NO: 1068, SEQ ID NO: 1069, SEQ ID NO: 1070, and/or SEQ ID NO: 1071. In some embodiments, genetically engineered bacteria comprise a nucleic acid sequence consisting of a sequence selected from SEQ ID NO: 1063, SEQ ID NO: 1064, SEQ ID NO: 1067, SEQ ID NO: 1068, SEQ ID NO: 1069, SEQ ID NO: 1070, and/or SEQ ID NO: 1071.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, and/or SEQ ID NO: 913. In some embodiments, genetically engineered bacteria comprise a nucleic acid sequence comprising a the DNA sequence selected from SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, and/or SEQ ID NO: 913. In some embodiments, genetically engineered bacteria comprise a nucleic acid sequence consisting of DNA sequence selected from SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, and/or SEQ ID NO: 913.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 914, SEQ ID NO: 915, SEQ ID NO: 916, SEQ ID NO: 917, SEQ ID NO: 918, and SEQ ID NO: 919. In some embodiments, genetically engineered bacteria comprise a nucleic acid sequence comprising a DNA sequence selected from SEQ ID NO: 914, SEQ ID NO: 915, SEQ ID NO: 916, SEQ ID NO: 917, SEQ ID NO: 918, and SEQ ID NO: 919. In some embodiments, genetically engineered bacteria comprise a nucleic acid sequence consisting of a DNA sequence selected from SEQ ID NO: 914, SEQ ID NO: 915, SEQ ID NO: 916, SEQ ID NO: 917, SEQ ID NO: 918, and SEQ ID NO: 919.

In one embodiment, genetically engineered bacteria comprise a gene sequence encoding a human IL-12α construct with a N terminal OmpF secretion tag, e.g., SEQ ID NO: 920. In one embodiment, genetically engineered bacteria comprise a gene sequence encoding a human IL-12α construct with a N terminal PhoA secretion tag, e.g., SEQ ID NO: 921. In one embodiment, genetically engineered bacteria comprise a gene sequence encoding a human IL-12a construct with a N terminal TorA secretion tag, e.g., SEQ ID NO: 922. In one embodiment, genetically engineered bacteria comprise a gene sequence encoding a human IL-12b construct with a N terminal OmpF secretion tag, e.g., SEQ ID NO: 923. In one embodiment, genetically engineered bacteria comprise a gene sequence encoding a human IL-12b construct with a N terminal PhoA secretion tag, e.g., SEQ ID NO: 924. In one embodiment, genetically engineered bacteria comprise a gene sequence encoding a human IL-12 construct with a N terminal TorA secretion tag, e.g., SEQ ID NO: 925. In one embodiment, genetically engineered bacteria comprise a gene sequence encoding a human GMCSF construct with a N terminal OmpF secretion tag, e.g., SEQ ID NO: 932. In one embodiment, genetically engineered bacteria comprise a gene sequence encoding a human GMCSF construct with a N terminal PhoA secretion tag, e.g., SEQ ID NO: 933. In one embodiment, genetically engineered bacteria comprise a gene sequence encoding a human GMCSF construct with a N terminal TorA secretion tag, e.g., SEQ ID NO: 934. In one embodiment, genetically engineered bacteria comprise a gene sequence encoding a human IL-15 construct with a N terminal OmpF secretion tag, e.g., SEQ ID NO: 935. In one embodiment, genetically engineered bacteria comprise a gene sequence encoding a human IL-15 construct with a N terminal PhoA secretion tag, e.g., SEQ ID NO: 936. In one embodiment, genetically engineered bacteria comprise a gene sequence encoding a human IL-15 construct with a N terminal TorA secretion tag, e.g., SEQ ID NO: 937. In one embodiment, genetically engineered bacteria comprise a gene sequence encoding a human TNFalpha construct with a N terminal OmpF secretion tag, e.g., SEQ ID NO: 938. In one embodiment, genetically engineered bacteria comprise a gene sequence encoding a human TNFa construct with a N terminal PhoA secretion tag, e.g., SEQ ID NO: 939. In one embodiment, genetically engineered bacteria comprise a gene sequence encoding a human TNFa construct with a N terminal TorA secretion tag, e.g., SEQ ID NO: 940. In one embodiment, genetically engineered bacteria comprise a gene sequence encoding a human IFNg construct with a N terminal OmpF secretion tag, e.g., SEQ ID NO: 941. In one embodiment, genetically engineered bacteria comprise a gene sequence encoding a human IFNg construct with a N terminal PhoA secretion tag, e.g., SEQ ID NO: 942. In one embodiment, genetically engineered bacteria comprise a gene sequence encoding a human IFNgamma construct with a N terminal TorA secretion tag, e.g., SEQ ID NO: 943. In one embodiment, genetically engineered bacteria comprise a gene sequence encoding a human CXCL9 construct with a N terminal OmpF secretion, e.g., SEQ ID NO: 1075. In one embodiment, genetically engineered bacteria comprise a gene sequence encoding a human CXCL9 construct with a N terminal PhoA secretion tag, e.g., SEQ ID NO: 1076. In one embodiment, genetically engineered bacteria comprise a gene sequence encoding a human CXCL9 construct with a N terminal TorA secretion tag, e.g., SEQ ID NO: 1077.

In some embodiments, genetically engineered bacteria comprise a gene sequence, which encodes a polypeptide that is at least about 80%, at least about 85%, at least about 90%, at least about 95%, or at least about 99% homologous to a polypeptide sequence selected from SEQ ID NO: 920-943 or 1072-1078, or a functional fragment or variant thereof. In some embodiments, genetically engineered bacteria comprise a gene sequence, which encodes a polypeptide that is at least about 80%, at least about 85%, at least about 90%, at least about 95%, or at least about 99% homologous to a polypeptide sequence selected from SEQ ID NO: 920-943 or 1072-1078. In some embodiments, genetically engineered bacteria comprise a gene sequence, which encodes a polypeptide comprising a sequence selected from SEQ ID NO: 920-943 or 1072-1078. In some embodiments, genetically engineered bacteria comprise a gene sequence, which encodes a polypeptide consisting of a sequence selected from SEQ ID NO: 920-943 or 1072-1078.

In some embodiments, genetically engineered bacteria comprise one or more nucleic acid sequences selected from SEQ ID NO: 953-960 and SEQ ID NO: 1081-1084. In some embodiments, genetically engineered bacteria comprise a nucleic acid sequence that is at least about 80%, at least about 85%, at least about 90%, at least about 95%, or at least about 99% homologous to one or more DNA sequences selected from SEQ ID NO: 953-960 and SEQ ID NO: 1081-1084.

In one embodiment, genetically engineered bacteria comprise a gene sequence comprising a construct comprising both human IL-12α and human IL-12b. In one embodiment, genetically engineered bacteria comprise a gene sequence comprising the phoA-hIL12b-phoA-hIL12a portion of SEQ ID NO: 965 or the phoA-mIL12b-phoA-mIL12a portion of SEQ ID NO: 966. In one embodiment, genetically engineered bacteria comprise a gene sequence comprising a construct comprising phoA-IL15. In one embodiment, genetically engineered bacteria comprise a gene sequence comprising the phoA-IL15 portion of SEQ ID NO: 967 In one embodiment, genetically engineered bacteria comprise a gene sequence comprising a construct comprising phoA-GMCSF. In one embodiment, genetically engineered bacteria comprise a gene sequence comprising the phoA-GMCSF portion of SEQ ID NO: 968. In one embodiment, genetically engineered bacteria comprise a gene sequence comprising a construct comprising phoA-TNFalpha. In one embodiment, genetically engineered bacteria comprise a gene sequence comprising the phoA-TNFalpha portion of SEQ ID NO: 969.

In one embodiment, genetically engineered bacteria comprise a gene sequence comprising a construct comprising phoA-IFNgamma. In one embodiment, genetically engineered bacteria comprise a gene sequence comprising the phoA-IFNgamma portion of SEQ ID NO: 970.

In one embodiment, genetically engineered bacteria comprise a gene sequence comprising a construct comprising phoA-hCXCL10. In one embodiment, genetically engineered bacteria comprise a gene sequence comprising the phoA-hCXCL10 portion of SEQ ID NO: 1085.

In one embodiment, genetically engineered bacteria comprise a gene sequence comprising a construct comprising phoA-hCXCL9. In one embodiment, genetically engineered bacteria comprise a gene sequence comprising the hCXCL9 portion of SEQ ID NO: 1087.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 1085 and SEQ ID NO: 1087.

In some embodiments, genetically engineered bacteria comprise a nucleic acid sequence that is at least about 80%, at least about 85%, at least about 90%, at least about 95%, or at least about 99% homologous a DNA sequence selected from SEQ ID NO: 965, SEQ ID NO: 966, SEQ ID NO: 967, SEQ ID NO: 968, SEQ ID NO: 969, SEQ ID NO: 970, excluding the non-coding regions.

Co-Stimulatory Molecules

CD40 is a costimulatory protein found on antigen presenting cells and is required for their activation. The binding of CD154 (CD40L) on T helper cells to CD40 activates antigen presenting cells and induces a variety of downstream immunostimulatory effects. In some embodiments, the anticancer molecule (e.g., immune modulator) is an agonist of CD40, for example, an agonist selected from an agonistic anti-CD40 antibody, agonistic anti-CD40 antibody fragment, CD40 ligand (CD40L) polypeptide, and CD40L polypeptide fragment. Thus, in some embodiments, the genetically engineered bacteria comprise sequence(s) encoding an agonistic anti-CD40 antibody, an agonistic anti-CD40 antibody fragment, a CD40 ligand (CD40L) polypeptide, or a CD40L polypeptide fragment.

Thus, in some embodiments, the engineered bacteria is engineered to produce an agonistic anti-CD40 antibody, an agonistic anti-CD40 antibody fragment, a CD40 ligand (CD40L) polypeptide, or a CD40L polypeptide fragment. In some embodiments, the engineered bacteria comprises sequence to encode an agonistic anti-CD40 antibody, an agonistic anti-CD40 antibody fragment, a CD40 ligand (CD40L) polypeptide, or a CD40L polypeptide fragment. In some embodiments, the engineered bacteria is engineered to over-express an agonistic anti-CD40 antibody, an agonistic anti-CD40 antibody fragment, a CD40 ligand (CD40L) polypeptide, or a CD40L polypeptide fragment, for example, operatively linked to a strong promoter and/or comprising more than one copy of any of these gene sequences. In some embodiments, the engineered bacteria comprises sequence(s) encoding two or more copies of an agonistic anti-CD40 antibody, an agonistic anti-CD40 antibody fragment, a CD40 ligand (CD40L) polypeptide, or a CD40L polypeptide fragment, e.g., two, three, four, five, six or more copies of any of these sequences. In some embodiments, the engineered bacteria comprises sequence(s) to encode an agonistic anti-CD40 antibody, an agonistic anti-CD40 antibody fragment, a CD40 ligand (CD40L) polypeptide, or a CD40L polypeptide fragment and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-CD40 antibody, an agonistic anti-CD40 antibody fragment, a CD40 ligand (CD40L) polypeptide, or a CD40L polypeptide fragment and/or expresses secretory peptide(s) under the control of a promoter that is activated by low-oxygen conditions. In some embodiments, the genetically engineered bacterium is a tumor-targeting bacterium that expresses an agonistic anti-CD40 antibody, an agonistic anti-CD40 antibody fragment, a CD40 ligand (CD40L) polypeptide, or a CD40L polypeptide fragment and/or expresses secretory peptide(s) under the control of a promoter that is activated by low-oxygen conditions. In certain embodiments, the genetically engineered bacteria express an agonistic anti-CD40 antibody, an agonistic anti-CD40 antibody fragment, a CD40 ligand (CD40L) polypeptide, or a CD40L polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-CD40 antibody, an agonistic anti-CD40 antibody fragment, a CD40 ligand (CD40L) polypeptide, or a CD40L polypeptide fragment and/or expresses secretory peptide(s), under the control of a cancer-specific promoter, a tissue-specific promoter, or a constitutive promoter, such as any of the promoters described herein.

In some embodiments, the engineered bacteria comprise gene sequence encoding one or more copies of an antibody directed against CD40. In some embodiments, the CD40 is human CD40. In some embodiments, the anti-CD40 antibody is an scFv. In some embodiments, the anti-CD40 antibody is secreted. In some embodiments, the anti-CD40 antibody is displayed on the cell surface. In any of these embodiments, the gene sequences comprising the hyaluronidase further encode a secretion tag selected from PhoA, OmpF, cvaC, TorA, FdnG, DmsA, and PelB. In some embodiments, the secretion tag is at the N terminus of the anti-CD40 polypeptide sequence and at the 5' end of the anti-CD40 coding sequence. In some embodiments, the secretion tag is at the C terminus of the anti-CD40 polypeptide sequence and at the 3' end of the anti-CD40 coding sequence. In one embodiment, the secretion tag is PhoA. In some embodiments, the genetically engineered bacteria further comprise one or more deletions in an outer membrane protein selected from lpp, nlP, tolA, and PAL. In some embodiments, the deleted or mutated outer membrane protein is PAL.

In some embodiments, the genetically engineered microorganisms are capable of expressing any one or more of the described stromal modulation circuits or gene sequences, e.g., hyaluronidase circuits, in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding stromal modulation circuits, e.g., hyaluronidase circuits, are controlled by a promoter inducible by such conditions and/or inducers in vivo and/or in vitro. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described stromal modulation gene sequences, e.g., hyaluronidase gene sequences, are present on one or more plasmids (e.g., high copy or low copy) or are integrated into one or more sites in the microorganismal chromosome. Also, in some embodiments, the genetically engineered microorganisms are further capable of expressing any one or more of the described stromal modulation, e.g., hyaluronidase circuits, and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

In any of these embodiments, the genetically engineered bacteria further encode hyaluronidase for secretion or for display on the cell surface. In any of these embodiments, the genetically engineered bacteria further comprise gene sequence(s) for the consumption of adenosine. In some embodiments, the gene sequence(s) for the consumption of adenosine comprise one or more genes selected from add, xapA, deoD, xdhA, xdhB, and xdhC. In some embodiments, the gene sequence(s) for the consumption of adenosine encode a transporter for importing adenosine. In some embodiments, the gene sequence(s) encoding a transporter comprise nupC. In some embodiments, the gene sequence(s) encoding a transporter comprise nupG.

CD28 is one of the proteins expressed on T cells that provide co-stimulatory signals required for T cell activation and survival. In some embodiments, the anti-cancer molecule (e.g., immune modulator) is an agonist of CD28, for example, an agonist selected from agonistic anti-CD28 antibody, agonistic anti-CD28 antibody fragment, CD80 (B7.1) polypeptide or polypeptide fragment thereof, and CD86 (B7.2) polypeptide or polypeptide fragment thereof. Thus, in some embodiments, the genetically engineered bacteria comprise sequence(s) encoding an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria is engineered to produce an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria comprises sequence to encode an agonistic anti-CD28 antibody, an agonistic anti-CD28 antibody fragment, a CD80 polypeptide, a CD80 polypeptide fragment, a CD86 polypeptide or a CD86 polypeptide fragment. In some embodiments, the engineered bacteria is engineered to over-express an agonistic anti-CD28 antibody, an agonistic anti-CD28 antibody fragment, a CD80 polypeptide, a CD80 polypeptide fragment, a CD86 polypeptide or a CD86 polypeptide fragment, for example, operatively linked to a strong promoter and/or comprising more than one copy of any of these gene sequences. In some embodiments, the engineered bacteria comprises sequence(s) encoding two or more copies of an agonistic anti-CD40 antibody, an agonistic anti-CD40 antibody fragment, a CD40 ligand (CD40L) polypeptide, or a CD40L polypeptide fragment, e.g., two, three, four, five, six or more copies of any of these sequences. In some embodiments, the engineered bacteria comprises sequence(s) to encode an agonistic anti-CD28 antibody, an agonistic anti-CD28 antibody fragment, a CD80 polypeptide, a CD80 polypeptide fragment, a CD86 polypeptide or a CD86 polypeptide fragment and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s) under the control of a promoter that is activated by low-oxygen conditions. In some embodiments, the genetically engineered bacterium is a tumor-targeting bacterium that expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s) under the control of a promoter that is activated by low-oxygen conditions. In certain embodiments, the genetically engineered bacteria express an agonistic anti-CD28 antibody, an agonistic anti-CD28 antibody fragment, a CD80 polypeptide, a CD80 polypeptide fragment, a CD86 polypeptide or a CD86 polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-CD28 antibody, an agonistic anti-CD28 antibody fragment, a CD80 polypeptide, a CD80 polypeptide fragment, a CD86 polypeptide or a CD86 polypeptide fragment and/or expresses secretory peptide(s), under the control of a cancer-specific promoter, a tissue-specific promoter, or a constitutive promoter, such as any of the promoters described herein.

ICOS is an inducible T-cell co-stimulator structurally and functionally related to CD28. In some embodiments, the anti-cancer molecule, e.g., immune modulator, is an agonist of ICOS, for example, an agonist selected from agonistic anti-ICOS antibody, agonistic anti-ICOS antibody fragment, ICOS ligand (ICOSL) polypeptide, and ICOSL polypeptide fragment. Thus, in some embodiments, the genetically engineered bacteria comprise sequence(s) encoding an agonistic anti-ICOS antibody, an agonistic anti-ICOS antibody fragment, a ICOSL polypeptide, or an ICOSL polypeptide fragment. Thus, in some embodiments, the engineered bacteria is engineered to produce an agonistic anti-ICOS antibody, an agonistic anti-ICOS antibody fragment, a ICOSL polypeptide, or an ICOSL polypeptide fragment. In some embodiments, the engineered bacteria comprises sequence to encode an agonistic anti-ICOS antibody, an agonistic anti-ICOS antibody fragment, a ICOSL polypeptide, or an ICOSL polypeptide fragment. In some embodiments, the engineered bacteria is engineered to over-express an agonistic anti-ICOS antibody, an agonistic anti-ICOS antibody fragment, a ICOSL polypeptide, or an ICOSL polypeptide fragment, for example, operatively linked to a strong promoter and/or comprising more than one copy of any of these gene sequences. In some embodiments, the engineered bacteria comprises sequence(s) encoding two or more copies of an agonistic anti-ICOS antibody, an agonistic anti-ICOS antibody fragment, a ICOSL polypeptide, or an ICOSL polypeptide fragment, e.g., two, three, four, five, six or more copies of any of these sequences. In some embodiments, the engineered bacteria comprises sequence(s) to encode an agonistic anti-ICOS antibody, an agonistic anti-ICOS antibody fragment, a ICOSL polypeptide, or an ICOSL polypeptide fragment and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-ICOS antibody, an agonistic anti-ICOS antibody fragment, a ICOSL polypeptide, or an ICOSL polypeptide fragment and/or expresses secretory peptide(s) under the control of a promoter that is activated by low-oxygen conditions. In some embodiments, the genetically engineered bacterium is a tumor-targeting bacterium that expresses an agonistic anti-ICOS antibody, an agonistic anti-ICOS antibody fragment, a ICOSL polypeptide, or an ICOSL polypeptide fragment and/or expresses secretory peptide(s) under the control of a promoter that is activated by low-oxygen conditions. In certain embodiments, the genetically engineered bacteria express an agonistic anti-ICOS antibody, an agonistic anti-ICOS antibody fragment, a ICOSL polypeptide, or an ICOSL polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-ICOS antibody, an agonistic anti-ICOS antibody fragment, a ICOSL polypeptide, or an ICOSL polypeptide fragment and/or expresses secretory peptide(s), under the control of a cancer-specific promoter, a tissue-specific promoter, or a constitutive promoter, such as any of the promoters described herein.

CD226 is a glycoprotein expressed on the surface of natural killer cells, platelets, monocytes, and a subset of T cells (e.g., CD8+ and CD4+ cells), which mediates cellular adhesion to other cells bearing its ligands, CD112 and CD155. Among other things, it is involved in immune synapse formation and triggers Natural Killer (NK) cell activation. In some embodiments, the anti-cancer molecule, e.g., immune modulator is an agonist of CD226, for example, an agonist selected from agonistic anti-CD226 antibody, agonistic anti-CD266 antibody fragment, CD112 polypeptide, CD112 polypeptide fragment, CD155 polypeptide, and CD155 polypeptide fragment. Thus, in some embodiments, the genetically engineered bacteria comprise sequence(s) encoding an agonistic anti-CD226 antibody, an agonistic anti-CD226 antibody fragment, a CD112 polypeptide, a CD112 polypeptide fragment, a CD155 polypeptide, or a CD155 polypeptide fragment. Thus, in some embodiments, the engineered bacteria is engineered to produce an agonistic anti-CD226 antibody, agonistic anti-CD266 antibody fragment, CD112 polypeptide, CD112 polypeptide fragment, CD155 polypeptide, and CD155 polypeptide fragment. In some embodiments, the engineered bacteria comprises sequence to encode an agonistic anti-CD226 antibody, agonistic anti-CD266 antibody fragment, CD112 polypeptide, CD112 polypeptide fragment, CD155 polypeptide, and CD155 polypeptide fragment. In some embodiments, the engineered bacteria is engineered to over-express an agonistic anti-CD226 antibody, agonistic anti-CD266 antibody fragment, CD112 polypeptide, CD112 polypeptide fragment, CD155 polypeptide, and CD155 polypeptide fragment, for example, operatively linked to a strong promoter and/or comprising more than one copy of any of these gene sequences. In some embodiments, the engineered bacteria comprises sequence(s) encoding two or more copies of an agonistic anti-CD226 antibody, agonistic anti-CD266 antibody fragment, CD112 polypeptide, CD112 polypeptide fragment, CD155 polypeptide, and CD155 polypeptide fragment, e.g., two, three, four, five, six or more copies of any of these sequences. In some embodiments, the engineered bacteria comprises sequence(s) to encode an agonistic anti-CD226 antibody, agonistic anti-CD266 antibody fragment, CD112 polypeptide, CD112 polypeptide fragment, CD155 polypeptide, and CD155 polypeptide fragment and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s) under the control of a promoter that is activated by low-oxygen conditions. In some embodiments, the genetically engineered bacterium is a tumor-targeting bacterium that expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s) under the control of a promoter that is activated by low-oxygen conditions. In certain embodiments, the genetically engineered bacteria express an agonistic anti-CD226 antibody, agonistic anti-CD266 antibody fragment, CD112 polypeptide, CD112 polypeptide fragment, CD155 polypeptide, and CD155 polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-CD226 antibody, agonistic anti-CD266 antibody fragment, CD112 polypeptide, CD112 polypeptide fragment, CD155 polypeptide, and CD155 polypeptide fragment and/or expresses secretory peptide(s), under the control of a cancer-specific promoter, a tissue-specific promoter, or a constitutive promoter, such as any of the promoters described herein.

CD137 or 4-1BB is a type 2 transmembrane glycoprotein belonging to the TNF superfamily, which is expressed and has a co-stimulatory activity on activated T Lymphocytes (e.g., CD8+ and CD4+ cells). It has been shown to enhance T cell proliferation, IL-2 secretion survival and cytolytic activity. In some embodiments, the anti-cancer molecule, e.g., immune modulator, is an agonist of CD137 (4-1BB), for example, an agonist selected from agonistic anti-CD137 antibody, agonistic anti-CD137 antibody fragment, CD137 ligand polypeptide (CD137L), and CD137L polypeptide fragment. Thus, in some embodiments, the genetically engineered bacteria comprise sequence(s) encoding an agonistic anti-CD137 antibody, an agonistic anti-CD137 antibody fragment, a CD137 ligand polypeptide, or a CD137 ligand polypeptide fragment. Thus, in some embodiments, the engineered bacteria is engineered to produce an agonistic anti-CD137 antibody, an agonistic anti-CD137 antibody fragment, a CD137 ligand polypeptide, or a CD137 ligand polypeptide fragment. In some embodiments, the engineered bacteria comprises sequence to encode an agonistic anti-CD137 antibody, an agonistic anti-CD137 antibody fragment, a CD137 ligand polypeptide, or a CD137 ligand polypeptide fragment. In some embodiments, the engineered bacteria is engineered to over-express an agonistic anti-CD137 antibody, an agonistic anti-CD137 antibody fragment, a CD137 ligand polypeptide, or a CD137 ligand polypeptide fragment, for example, operatively linked to a strong promoter and/or comprising more than one copy of any of these gene sequences. In some embodiments, the engineered bacteria comprises sequence(s) encoding two or more copies of an agonistic anti-CD137 antibody, an agonistic anti-CD137 antibody fragment, a CD137 ligand polypeptide, or a CD137 ligand polypeptide fragment, e.g., two, three, four, five, six or more copies of any of these sequences. In some embodiments, the engineered bacteria comprises sequence(s) to encode an agonistic anti-CD137 antibody, an agonistic anti-CD137 antibody fragment, a CD137 ligand polypeptide, or a CD137 ligand polypeptide fragment, and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-CD137 antibody, an agonistic anti-CD137 antibody fragment, a CD137 ligand polypeptide, or a CD137 ligand polypeptide fragment, and/or expresses secretory peptide(s) under the control of a promoter that is activated by low-oxygen conditions. In some embodiments, the genetically engineered bacterium is a tumor-targeting bacterium that expresses agonistic anti-CD137 antibody, an agonistic anti-CD137 antibody fragment, a CD137 ligand polypeptide, or a CD137 ligand polypeptide fragment, and/or expresses secretory peptide(s) under the control of a promoter that is activated by low-oxygen conditions. In certain embodiments, the genetically engineered bacteria express an agonistic anti-CD137 antibody, an agonistic anti-CD137 antibody fragment, a CD137 ligand polypeptide, or a CD137 ligand polypeptide fragment, and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-CD137 antibody, an agonistic anti-CD137 antibody fragment, a CD137 ligand polypeptide, or a CD137 ligand polypeptide fragment, and/or expresses secretory peptide(s), under the control of a cancer-specific promoter, a tissue-specific promoter, or a constitutive promoter, such as any of the promoters described herein.

OX40, or CD134, is a T-cell receptor involved in preserving the survival of T cells and subsequently increasing cytokine production. OX40 has a critical role in the maintenance of an immune response and a memory response due to its ability to enhance survival. It also plays a significant role in both Th1 and Th2 mediated reactions. In some embodiments, the anti-cancer molecule, e.g., immune modulator, is an agonist of OX40, for example, an agonist selected from agonistic anti-OX40 antibody, agonistic anti-OX40 antibody fragment, OX40 ligand (OX40L), and OX40L fragment. Thus, in some embodiments, the genetically engineered bacteria comprise sequence(s) encoding an agonistic anti-OX40 or anti-CD134 antibody, an agonistic anti-OX40 or anti-CD134 antibody fragment, a OX40L polypeptide, or a OX40L polypeptide fragment. Thus, in some embodiments, the engineered bacteria is engineered to produce an agonistic anti-OX40 or anti-CD134 antibody, an agonistic anti-OX40 or anti-CD134 antibody fragment, a OX40L polypeptide, or a OX40L polypeptide fragment. In some embodiments, the engineered bacteria comprises sequence to encode an agonistic anti-OX40 or anti-CD134 antibody, an agonistic anti-OX40 or anti-CD134 antibody fragment, a OX40L polypeptide, or a OX40L polypeptide fragment. In some embodiments, the engineered bacteria is engineered to over-express an agonistic anti-OX40 or anti-CD134 antibody, an agonistic anti-OX40 or anti-CD134 antibody fragment, a OX40L polypeptide, or a OX40L polypeptide fragment for example, operatively linked to a strong promoter and/or comprising more than one copy of any of these gene sequences. In some embodiments, the engineered bacteria comprises sequence(s) encoding two or more copies of an agonistic anti-OX40 or anti-CD134 antibody, an agonistic anti-OX40 or anti-CD134 antibody fragment, a OX40L polypeptide, or a OX40L polypeptide fragment, e.g., two, three, four, five, six or more copies of any of these sequences. In some embodiments, the engineered bacteria comprises sequence(s) to encode an agonistic anti-OX40 or anti-CD134 antibody, an agonistic anti-OX40 or anti-CD134 antibody fragment, a OX40L polypeptide, or a OX40L polypeptide fragment and sequence to encode a secretory peptide(s) for the secretion of said antibodies and polypeptides. In any of these embodiments, the genetically engineered bacteria is a tumor-targeting bacterium. In some embodiments, the genetically engineered bacterium expresses an agonistic anti-OX40 or anti-CD134 antibody, an agonistic anti-OX40 or anti-CD134 antibody fragment, a OX40L polypeptide, or a OX40L polypeptide fragment and/or expresses secretory peptide(s) under the control of a promoter that is activated by low-oxygen conditions. In some embodiments, the genetically engineered bacterium is a tumor-targeting bacterium that expresses agonistic anti-OX40 or anti-CD134 antibody, an agonistic anti-OX40 or anti-CD134 antibody fragment, a OX40L polypeptide, or a OX40L polypeptide fragment and/or expresses secretory peptide(s) under the control of a promoter that is activated by low-oxygen conditions. In certain embodiments, the genetically engineered bacteria express an agonistic anti-OX40 or anti-CD134 antibody, an agonistic anti-OX40 or anti-CD134 antibody fragment, a OX40L polypeptide, or a OX40L polypeptide fragment and/or secretory peptide(s), under the control of a promoter that is activated by hypoxic conditions, or by inflammatory conditions, such as any of the promoters activated by said conditions and described herein. In some embodiments, the genetically engineered bacteria expresses an agonistic anti-OX40 or anti-CD134 antibody, an agonistic anti-OX40 or anti-CD134 antibody fragment, a OX40L polypeptide, or a OX40L polypeptide fragment and/or expresses secretory peptide(s), under the control of a cancer-specific promoter, a tissue-specific promoter, or a constitutive promoter, such as any of the promoters described herein.

In any of these embodiments, the antibody may be a human antibody or humanized antibody and may comprise different isotypes, e.g., human IgG1, IgG2, IgG3 and IgG4's. Also, the antibody may comprise a constant region that is modified to increase or decrease an effector function such as FcR binding, FcRn binding, complement function, glycosylation, C1q binding; complement dependent cytotoxicity (CDC); Fc receptor binding; antibody-dependent cell-mediated cytotoxicity (ADCC); phagocytosis; down-regulation of cell surface receptors (e.g. B cell receptor; BCR). In any of these embodiments, the antibody may be a single chain antibody or a single chain antibody fragment.

Antigens/Vaccines

By introducing tumor antigens, e.g., tumor-specific antigens, tumor-associated antigens (TAA(s)), and/or neoantigen(s) to the local tumor environment, an immune response can be raised against the particular cancer or tumor cell of interest known to be associated with that neoantigen. As used herein the term "tumor antigen" is meant to refer to tumor-specific antigens, tumor-associated antigens (TAAs), and neoantigens. As used herein, tumor antigen also includes "Oncogenic viral antigens", Oncofetal antigens, tissue differentiation antigens, and cancer-testis antigens.

The engineered microorganisms can be engineered such that the peptides, e.g. tumor antigens, can be anchored in the microbial cell wall (e.g., at the microbial cell surface). These are known as wall anchored antigens Thus, in some embodiments, the genetically engineered bacteria, are engineered to produce one or more tumor antigens. In some embodiments, the genetically engineered bacteria are engineered to produce one or more tumor-specific antigens. In some embodiments, the genetically engineered bacteria are engineered to produce one or more tumor-associated antigens. In some embodiments, the genetically engineered bacteria are engineered to produce one or more neoantigens. In some embodiments, the genetically engineered bacteria are engineered to produce one or more antigens selected from oncogenic viral antigens, oncofetal antigens, altered cell surface glycolipids and glycoproteins, tissue differentiation antigens, cancer-testis antigens, and idiotypic antigens. Exemplary tumor antigens, e.g., tumor-specific antigens, tumor-associated antigens, and/or neoantigen(s) are provided herein and otherwise known in the art.

In some embodiments, the antigens are secreted into the tumor microenvironment, where they are taken up by immune cells for antigen presentation. Thus, in some embodiments, the genetically engineered bacteria comprise sequence(s) for encoding one or more tumor antigens, e.g., tumor-specific antigens, tumor-associated antigens, and/or neoantigen(s), and sequence that allows for the secretion of the antigens, such as any of the secretion systems, methods and sequences described herein. In some embodiments, the antigens are anchored to the engineered microbial cell wall, membrane, or capsid. Thus, in some embodiments, the genetically engineered bacteria are engineered to produce one or more tumor antigens, e.g., tumor-specific antigens, tumor-associated antigens, and/or neoantigen(s), that are a wall anchored antigen(s). In some embodiments, the genetically engineered bacteria comprise sequence(s) for encoding one or more tumor antigens, e.g., tumor-specific antigens, tumor-associated antigens, and/or neoantigen(s), and sequence that targets the antigens to the cell wall, membrane or capsid, such as any of the cell wall targeting methods and sequences described herein In some embodiments, the genetically engineered bacteria comprise one or more gene sequences selected from SEQ ID NO: 160-561. In some embodiments, the sequence is at least about 80%, at least about 85%, at least about 90%, at least about 95%, or at least about 99% homologous to the sequence of any one of SEQ ID NOs: 160-561.

Other Immune Modulators

In some embodiments, the genetically engineered bacteria are capable of producing an immune modulator that modulates M2 macrophage inducing cytokines and/or growth factors. In some embodiments, the genetically engineered bacteria are capable of producing an immune modulator that inhibits M2 macrophage inducing cytokines and/or growth factors. In some embodiments, the genetically engineered bacteria are capable of producing an immune modulator that modulates M1 macrophages. In some embodiments, the genetically engineered bacteria are capable of producing an immune modulator that induces M1 macrophages.

In some embodiments, the genetically engineered bacteria are capable of producing an immune modulator that modulates myeloid-derived suppressor cells (MDSC). In some embodiments, the genetically engineered bacteria are capable of producing an immune modulator that inhibits MDSC function. In some embodiments, the genetically engineered bacteria are capable of producing an immune modulator that modulates antigen presenting cell and T cell interactions. In some embodiments, the genetically engineered bacteria are capable of producing an immune modulator that modulates CTL/CD8+ T cell inducing cytokines and/or growth factors. In some embodiments, the genetically engineered bacteria are capable of producing an immune modulator that stimulates CTL/CD8+ T cell inducing cytokines and/or growth factors. In some embodiments, the genetically engineered bacteria are capable of producing an immune modulator that modulates chemokines that attack immunosuppressive cells. In some embodiments, the genetically engineered bacteria are capable of producing an immune modulator that stimulates chemokines that attack immunosuppressive cells. In some embodiments, the genetically engineered bacteria are capable of producing an immune modulator such as any of those found in Table 8 below.

TABLE 8

Exemplary Immune Modulators
Immune Modulators

| Compound | Role |
| --- | --- |
| TLR agonists (TLR4, TLR7, TLR8, TLR9) | Dendritic Cell Activation |
| NLR agonists | |
| STING agonists | |
| INF-alpgha/beta | |
| GM-CSF | |
| Antagonists of IL-4, IL-13, IL-10 | Block Induction of M2 Macrophage |
| M-CSF Antagonists | |
| GM-CSF | Induction of M1 Macrophage |
| Interferon-γ | |
| Inhibit Tryptophan Oxygenase (TDO) | Tryptophan and Kynurenine Metabolism |
| Inhibit Tryptophan Pyrrolase (IDO) | |
| Arginase | Block MDSC Mediated T Cell Suppression |
| Antagonists of ARG1/2, iNOS, PDE5 | |
| PD1/PDL1 antagonist | Immune Regulation |
| CD80/86 antagonist | |
| B7-H3/B7-H4 antagonist | |
| HVEM antagonist | |
| LAG3 antagonist | |
| CTLA4 antagonist | |
| TIM3 antagonist | |
| ICOS or ICOS agonist | |
| OX40 or OX40 agonist | |
| CD137 or CD137 agonist | |
| CD27 or CD27 agonist | |
| CD40 or CD40 agonist | |

TABLE 8-continued

Exemplary Immune Modulators
Immune Modulators

| Compound | Role |
| --- | --- |
| IL-7, IL-15, IL-21, IL-18, IL-2, IL-12, (Localized Delivery) | CTL/CD8+ T Cell Stimulation |
| CCL5, CXCL1, CXCL12, CCL2 (binding to CCR5, CXCR1, CXCR4, CCR2) | Modulate Immunosuppression |
| A2aR- Adenosine antagonist | Anti-Inflammatory Effects |
| cAMP antagonist | Protein Kinase Activator |

Other Anti-Cancer Molecules

In some embodiments, the genetically engineered bacteria are capable of producing cytotoxic, anti-neoplastic molecules. For example, the genetically engineered bacteria are capable of producing azurin, e.g., *P. aeruginosa* azurin, a bacterial redox protein that is capable of entering human cancer cells and inducing apoptosis (Bernardes et al., 2013; Zang et al., 2012). In some embodiments, the genetically engineered bacterium is a tumor-targeting bacterium that is capable of expressing azurin under the control of a promoter that is activated by low-oxygen conditions.

In alternate embodiments, the anti-cancer molecule is selected from a cytotoxic agent, Cly A, FASL, TRAIL, TNF-alpha, a cytokine, CCL21, IL-2, IL-18, LIGHT, an antigen, an antibody, a single-chain antibody, a CtxB-PSA fusion protein, a CPV-OmpA fusion protein, a NY-ESO-1 tumor antigen, RAF1, a single-chain HIF1-alpha antibody, a single-chain CTLA-4 antibody, a single-chain PD-1 antibody, endostatin, thrombospondin-1, TRAIL, SMAC, Stat3, Bcl2, FLT3L, GM-CSF, IL-12, AFP, VEGFR2, an enzyme, *E. coli* CD, and HSV-TK. In some embodiments, the genetically engineered bacteria of the invention are tumor-targeting bacteria comprising a gene encoding a single-chain HIF1-alpha antibody, and are capable of delivering the anti-cancer molecule specifically and locally to cancerous cells.

CD166, a member of the immunoglobulin superfamily and a ligand for the lymphocyte antigen CD6, mediates homophilic and heterophilic adhesion. It is expressed on activated leukocytes T cells, B cells, monocytes, hematopoietic stem cells (HSCs), metastasizing melanoma, neuronal cells, endothelial cells, hematopoiesis-supporting osteoblastic cell lines, and MDSCs. In one embodiment, the genetically engineered bacteria contain one or more gene(s) encoding a single chain antibody directed against CD166. In another embodiment, the genetically engineered OVs encode a single chain antibody directed against CD70. A non-limiting example of a single chain antibody against CD166 is described in Immunotherapy November 2010, Volume 59, Issue 11, pp 1665-1674.

Other anti-cancer molecules include therapeutic nucleic acids (RNA and DNA), for example, RNAi molecules (such as siRNA, miRNA, dsRNA), mRNAs, antisense molecules, aptamers, and CRISPER/Cas 9 molecules as described in International Patent Application PCT/US2017/013072, filed Jan. 11, 2017, published as WO2017/123675, the contents of which is herein incorporated by reference in its entirety. Thus, in some embodiments, the genetically engineered bacteria comprise sequence(s) for producing one or anti-cancer molecules that are RNA or DNA anti-cancer molecules, e.g., including nucleic acid molecules selected from RNAi molecules (siRNA, miRNA, dsRNA), mRNAs, antisense molecules, aptamers, and CRISPR/Cas 9 molecules. Such molecules are exemplified and discussed in the references provided herein below.

In some embodiments, the genetically engineered bacteria may be administered in combination with a therapeutic adoptive cell therapy, such as any of the adoptive cell therapy described as described in International Patent Application PCT/US2017/013072, filed Jan. 11, 2017, published as WO2017/123675, the contents of which is herein incorporated by reference in its entirety, or otherwise known in the art.

In other embodiments, one or more TCR therapies described in International Patent Application PCT/US2017/013072, filed Jan. 11, 2017, published as WO2017/123675, the contents of which is herein incorporated by reference in its entirety, or otherwise known in the art can be administered in combination with a genetically engineered bacteria of the present invention.

BiTE antibodies are recombinant fusion proteins consisting of scFvs of two different antibodies, which are connected by a flexible linker, and therefore have two different binding sites. In some embodiments, the genetically engineered bacteria may encode one or more BiTE antibody(ies), e.g., directed against one or more of the immune modulators described herein. For example, in some embodiments, the BiTE antibody is directed against an immune checkpoint, e.g., against CTLA-4, PD-1, or PD-L1. In some embodiments, the BiTE antibody is directed against CD47 or SIRPα. In other embodiments, one or more BiTE antibodies can be administered in combination with a genetically engineered bacteria of the present invention. In some embodiments, the genetically engineered bacteria of the disclosure produce an antibody of SEQ ID NO: 562 or a fragment or variant thereof.

In any of the anti-cancer molecule production embodiments described herein, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more anti-cancer molecule than unmodified bacteria of the same bacterial subtype under the same conditions.

In yet another anti-cancer molecule production embodiment, the genetically engineered bacteria produce at least about 1.0-1.2-fold, 1.2-1.4-fold, 1.4-1.6-fold, 1.6-1.8-fold, 1.8-2-fold, or two-fold more anti-cancer molecule than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more anti-cancer molecule than unmodified bacteria of the same bacterial subtype under the same conditions.

In any of the anti-cancer molecule production embodiments described herein, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more substrate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria substrate about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of anti-cancer molecule production embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of the anti-cancer molecule production embodiments described herein, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of the anti-cancer molecule production embodiments described herein, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of the anti-cancer molecule production embodiments described herein, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of the anti-cancer molecule production embodiments described herein, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

Prodrugs

Prodrug therapy provides less reactive and cytotoxic form of anticancer drugs. In some embodiments, the genetically engineered bacteria are capable of converting a prodrug into its active form. One example of a suitable prodrug system is the 5-FC/5-FU system.

The cytotoxic and radiosensitizing agent 5-fluorouracil (5-FU) is used in the treatment of many cancers including gastrointestinal, breast, head and neck and colorectal cancers (Duivenvorrden et al., 2006, Sensitivity of 5-fluorouracil-resistant cancer cells to adenovirus suicide gene therapy; Cancer Gene Therapy (2006) 14, 57-65). However, Toxicity limits its administration at higher concentrations. In order to achieve higher concentrations at the tumor with less toxicity, a prodrug system was developed. Cytosine deaminase deaminates the prodrug 5-fluorocytosine (5-FC) into 5-FU. 5-FC can be introduced at relatively high concentrations, allowing the 5-FU generated at the tumor site to achieve concentrations that are higher than can be systemically administered safely. At the tumor site 5-FU is then transformed by cellular enzymes to potent pyrimidine antimetabolites, 5-FdUMP, 5-FdUTP and 5-FUTP. These metabolites act as metabolic blockers that inhibit thymidylate synthetase, which converts ribonucleotides to deoxyribonucleotides, thus inhibiting DNA synthesis ((Horani et al.

2015, Anticancer Prodrugs—Three Decades Of Design; wjpps; Volume 4, Issue 07, 1751-1779, and references therein).

This system has been further improved by the inclusion of the UPRT that converts 5-FU to 5-fluorouridine monophosphate, the first step of its pathway to activation, similar to the actions of the mammalian orotate phosphoribosyltransferase (Tiraby et al., 1998; Concomitant expression of *E. coli* cytosine deaminase and uracil phosphoribosyltransferase improves the cytotoxicity of 5-fluorocytosine. FEMS Microbiol Lett 1998; 176: 41-49).

In some embodiments, the genetically engineered bacteria comprise gene sequences encoding a cytosine deaminase (EC 3.5.4.1)

In some embodiments, the cytosine deaminase is from *E. coli*. In some embodiments, the cytosine deaminase is codA. In some embodiments, the genetically engineered bacteria express cytosine deaminase from yeast. In some embodiments, the genetically engineered bacteria express a codA-upp fusion protein.

Non-limiting examples of cytosine deaminases suitable for heterologous expression in the genetically engineered bacteria include *Photobacterium leiognathi* subsp. *mandapamensis* svers.1.1. (PMSV_1378), *Pseudomonas mendocina* NK-01 (MDS_1548), *Streptomyces coelicolor* A3(2) (SCO4634), *Achromobacter xylosoxidans* AXX-A (AXXA_10715, AXXA_16292), *Gluconacetobacter* sp. SXCC-1 (CODA), *Gallibacterium anatis* UMN179 (UMN179_00049), *Klebsiella oxytoca* KCTC 1686 (KOX_14050, KOX_04555), *Taylorella asinigenitalis* MCE3 (TASI_1310), *Rhodococcus jostii* RHA1 (RHA1_R000599, RHA1_R000597), *Enterobacter aerogenes* KCTC 2190 (EAE_13265, EAE_05115), *Candidatus arthromitus* sp. SFB-mouse-Japan (SFBM_1249), *Ralstonia solanacearum* Po82 (CODA), *Salinisphaera shabanensis* E1L3A (SSPSH_07086), *Paenibacillus mucilaginosus* KNP414 (KNP414_03230, KNP414_03233), *Bradyrhizobium japonicum* USDA 6 (BJ6T_60100, BJ6T_60090), *Candidatus arthromitus* sp. SFB-rat-Yit (RATSFB_1079), *Pseudomonas putida* S16 (PPS_2740), *Weissella koreensis* KACC 15510 (WKK_05060), *Enterobacter cloacae* EcWSU1 (YAHJ, CODA), *Bizionia argentinensis* JUB59 (BZARG_2213), *Agrobacterium tumefaciens* F2 (AGAU_L101956), *Paracoccus denitrificans* SD1 (PDI_1216), *Sulfobacillus acidophilus* TPY (CODA), *Vibrio tubiashii* ATCC 19109 (VITU9109_13741), *Nitrosococcus watsonii* C-113 (NWAT_2475), *Blattabacterium* sp. (*Mastotermes darwiniensis*) str. MADAR (CODA), *Blattabacterium* sp. (*Cryptocercus punctulatus*) str. Cpu (CODA), *Pelagibacterium halotolerans* B2 (KKY_852, KKY_850), *Burkholderia* sp. YI23 (BY123_A018410, BY123_A008960), *Synechococcus* sp. CC9605 (SYNCC9605_0854), *Pseudomonas fluorescens* F113 (AEV61892.1), *Vibrio* sp. EJY3 (VEJY3_16491), *Synechococcus elongatus* PCC 7942 (SYNPCC7942_0568), *Bradyrhizobium* sp. ORS 278 (BRADO1789, BRADO0862), *Synechocystis* sp. PCC 6803 (CODA), *Microcoleus chthonoplastes* PCC 7420 (MC7420_274), *Prochlorococcus marinus* str. AS9601 (CODA), *Escherichia coli* O157:H7 str. EDL933 (YAHJ, CODA), *Pseudomonas putida* KT2440 (CODA), *Synechococcus* sp. WH 8109 (SH8109_1371), *Prochlorococcus marinus* subsp. *marinus* str. CCMP1375 (SSNA), *Prochlorococcus marinus* str. MIT 9515 (CODA), *Prochlorococcus marinus* str. MIT 9301 (CODA), *Prochlorococcus marinus* str. NATL1A (CODA), *Agrobacterium tumefaciens* str. C58 (ATU4698), *Desulfobacterium autotrophicum* HRM2 (CODA), *Cyanobium* sp. PCC 7001 (CPCC7001_2605), *Yersinia pestis* KIM10 (CODA), *Clostridium perfringens* ATCC 13124 (CODA), *Nocardioides* sp. JS614 (NOCA_1495), *Corynebacterium efficiens* YS-314 (CODA), *Corynebacterium glutamicum* ATCC 13032 (CGL0076, CODA), *Bacillus anthracis* str. Ames (BAS4389), *Dickeya dadantii* 3937 (CODA), *Escherichia coli* CFT073 (CODA, YAHJ), *Trichodesmium erythraeum* IMS101 (TERY_4570), *Pseudomonas fluorescens* Pf0-1 (CODA, PFL01_3146), *Bifidobacterium longum* NCC2705 (CODA), *Carnobacterium* sp. 17-4 (CAR_C04640, ATZC), *Pseudomonas aeruginosa* PAO1 (CODA), *Clostridium tetani* E88 (CTC_01883), *Yersinia pestis* C092 (CODA), *Burkholderia cenocepacia* J2315 (BCAM2780, CODA), *Pseudomonas fluorescens* SBW25 (CODA), *Vibrio vulnificus* CMCP6 (VV2_0789), *Salmonella bongori* NCTC 12419 (CODA), *Salmonella enterica* subsp. *enterica* serovar Typhi str. CT18 (CODA), *Pseudomonas fluorescens* Pf-5 (CODA), *Oceanobacillus iheyensis* HTE831 (OB1267), *Synechococcus* sp. RS9916 (RS9916_32902), *Synechococcus* sp. RS9917 (RS9917_02061), *Mannheimia succiniciproducens* MBEL55E (SSNA), *Vibrio parahaemolyticus* RIMD 2210633 (VPA1243), *Bradyrhizobium japonicum* USDA 110 (BLL3846, BLL7276), *Marinobacter adhaerens* HP15 (HP15_2772), *Enterococcus faecalis* V583 3 seqs EF_1061, EF_1062, EF_0390), *Bacillus cereus* ATCC 14579 (BC_4503), *Synechococcus* sp. CB0101 (SCB01_010100001875), *Synechococcus* sp. CB0205 (SCB02_010100013621), *Burkholderia mallei* ATCC 23344 (CODA), *Labrenzia alexandrii* DFL-11 (SADFL11_5050), *Myxococcus xanthus* DK 1622 (MXAN_5420), *Ruegeria pomeroyi* DSS-3 (SP02806), *Gloeobacter violaceus* PCC 7421 (GLL2528), *Streptomyces* sp. C (SSNG_03287, SSNG_04186), *Ralstonia eutropha* JMP134 (REUT_B3993), *Moorella thermoacetica* ATCC 39073 (MOTH_0460), *Rubrobacter xylanophilus* DSM 9941 (RXYL_0224), *Burkholderia xenovorans* LB400 (BXE_A2120, BXE_A1533), *Sinorhizobium meliloti* 1021 (R02596), *Mesorhizobium loti* MAFF303099 (MLR5363, MLL2061), *Ralstonia solanacearum* GMI1000 (CODA), *Synechococcus elongatus* PCC 6301 (CODA), *Burkholderia vietnamiensis* G4 (BCEP1808_4874), *Rhodospirillum rubrum* ATCC 11170 (RRU_A2788), *Marinobacter* sp. ELB17 (MELB17_06099), *Gluconacetobacter diazotrophicus* PA15 (GDIA_2518, GDI3632), *Klebsiella pneumoniae* subsp. *pneumoniae* MGH 78578 (KPN_00632, CODA), *Pasteurella multocida* subsp. *multocida* str. Pm70 (PM0565), *Rhodobacter sphaeroides* 2.4.1 (RSP_0341), *Pediococcus pentosaceus* ATCC 25745 (PEPE_0241), *Pseudogulbenkiania ferrooxidans* 2002 (FURADRAFT_0739), *Desulfuromonas acetoxidans* DSM 684 (DACE_0684), *Aurantimonas manganoxydans* SI85-9A1 (SI859A1_01947), *Bradyrhizobium* sp. BTAi1 (BBTA_2105, BBTA_7204), *Cronobacter sakazakii* ATCC BAA-894 (ESA_03405), *Arthrobacter aurescens* TC1 (AAUR_3889, AAUR_0925), *Arthrobacter* sp. FB24 (ARTH_3600), *Jannaschia* sp. CCS1 (JANN_1306), *Polaromonas* sp. JS666 (BPRO_1960), *Photobacterium profundum* SS9 (Y3946), *Frankia* sp. EuI1c (FRAEUI1C_4724, FRAEUI1C_4625), *Thermomicrobium roseum* DSM 5159 (TRD_1845), *Agrobacterium vitis* S4 (AVI_2101, AVI_2102), *Agrobacterium radiobacter* K84 5 seqs ARAD_9085, ARAD_9086, ARAD_8033, ARAD_3518, ARAD_9893), *Vibrio fischeri* ES114 (CODA), *Lyngbya* sp. PCC 8106 (L8106_10086), *Synechococcus* sp. BL107 (BL107_11056), *Bacillus* sp. NRRL B-14911 (B14911_04044), *Roseobacter* sp. MED193

(MED193_17224), *Roseovarius* sp. 217 (R05217_10957), *Pelagibaca bermudensis* HTCC2601 (R2601_16485, R2601_00530), *Marinomonas* sp. MED121 (MED121_23629), *Lactobacillus sakei* subsp. *sakei* 23K (LCA_1212), *Bacillus weihenstephanensis* KBAB4 (BCERKBAB4_4331), *Rhodopseudomonas palustris* HaA2 (RPB_2084), *Aliivibrio salmonicida* LFI1238 (CODA), *Synechococcus* sp. CC9902 (SYNCC9902_1538), *Escherichia coli* str. K-12 substr. W3110 (CODA, YAHJ), *Paracoccus denitrificans* PD1222 (PDEN_1057), *Synechococcus* sp. WH 7803 (CODA), *Synechococcus* sp. JA-3-3Ab (CYA_1567, CODA), *Synechococcus* sp. JA-2-3Ba(2-13) (CYB_1063, CODA), *Brevibacterium linens* BL2 (BLINB_010200009485), *Azotobacter vinelandii* DJ (CODA), *Paenibacillus* sp. JDR-2 6 seqs PJDR2_6131, PJDR2_6134, PJDR2_3617, PJDR2_3622, PJDR2_3255, PJDR2_3254), *Frankia alni* ACN14a (FRAAL4250), *Bifidobacterium breve* UCC2003 (CODA), *Blattabacterium* sp. (*Blattella germanica*) str. Bge (BLBBGE_353), alpha proteobacterium BAL199 (BAL199_01644, BAL199_09865), *Carnobacterium* sp. AT7 (CAT7_10495, CAT7_05806), *Nitrosomonas eutropha* C91 (NEUT_1722), *Vibrio harveyi* ATCC BAA-1116 (VIBHAR_05319), *Burkholderia ambifaria* AMMD (BAMB_3745, BAMB_4900), *Actinobacillus succinogenes* 130Z (ASUC_1190), *Rhodobacter sphaeroides* ATCC 17025 (RSPH17025_0955), *Lactobacillus reuteri* 100-23 (LR0661), *Acidiphilium cryptum* JF-5 (ACRY_0828), *Hahella chejuensis* KCTC 2396 (HCH_05147), *Alkaliphilus oremlandii* OhILAs (CLOS_1212, CLOS_2457), *Burkholderia dolosa* AUO158 (BDAG_04094, BDAG_03273), *Roseobacter* sp. AzwK-3b (RAZWK3B_08901), *Pseudomonas putida* F1 (PPUT_2527), *Clostridium phytofermentans* ISDg (CPHY_3622), *Brevibacillus brevis* NBRC 100599 4 seqs BBR47_15870, BBR47_15630, BBR47_15620, BBR47_15610), *Bordetella avium* 197N (CODA), *Escherichia coli* 536 (CODA, YAHJ), *Polaromonas naphthalenivorans* CJ2 (PNAP_4007), *Ramlibacter tataouinensis* TTB310 (CODA), *Janthinobacterium* sp. Marseille (CODA), *Pseudomonas stutzeri* A1501 (CODA), *Aeromonas hydrophila* subsp. *hydrophila* ATCC 7966 (CODA), *Ralstonia eutropha* H16 (CODA, SSNA), *Pseudomonas entomophila* L48 (PSEEN3598), *Labrenzia aggregata* IAM 12614 (SIAM614_16372, SIAM614_21000), *Lactobacillus brevis* ATCC 367 (LVIS_1932), *Sagittula stellata* E-37 (SSE37_18952), *Bacillus* sp. B14905 3 seqs BB14905_20948, BB14905_12010, BB14905_12015), *Pseudomonas putida* W619 3 seqs PPUTW619_3228, PPUTW619_2210, PPUTW619_2162), *Stenotrophomonas maltophilia* R551-3 (SMAL_2348), *Burkholderia phymatum* STM815 (BPHY_1477), *Vibrionales bacterium* SWAT-3 (VSWAT3_26556), *Roseobacter* sp. GAI101 (RGAI101_2568), *Vibrio shilonii* AK1 (VSAK1_17107), *Pedobacter* sp. BAL39 (PBAL39_00410), *Roseovarius* sp. TM1035 (RTM1035_18230, RTM1035_17900), *Octadecabacter antarcticus* 238 (OA238_4970), *Phaeobacter gallaeciensis* DSM 17395 (CODA), *Oceanibulbus indolifex* HEL-45 (OIHEL45_14065, OIHEL45_01925), *Octadecabacter antarcticus* 307 (OA307_78), *Verminephrobacter eiseniae* EF01-2 (VEIS_0416, VEIS_4430), *Shewanella woodyi* ATCC 51908 (SWOO_1853), *Yersinia enterocolitica* subsp. *enterocolitica* 8081 (CODA), *Clostridium cellulolyticum* H10 (CCEL_0909), *Burkholderia multivorans* ATCC 17616 (CODA, BMUL_4281), *Leptothrix cholodnii* SP-6 (LCHO_0318), *Acidovorax citrulli* AAC00-1 (AAVE_3221), *Burkholderia phytofirmans* PsJN (BPHYT_2598, BPHYT_2388), *Delftia acidovorans* SPH-1 (DACI_4995), *Shewanella pealeana* ATCC 700345 (SPEA_2187), *Dinoroseobacter shibae* DFL 12 (CODA), *Pseudomonas mendocina* ymp (PMEN_3834), *Serratia proteamaculans* 568 (SPRO_0096, SPRO_4594), *Enterobacter* sp. 638 (ENT638_3792, ENT638_3140), *Marinomonas* sp. MWYL1 (MMWYL1_1583), *Saccharopolyspora erythraea* NRRL 2338 (SERYN2_010100001217), *Xenorhabdus nematophila* ATCC 19061 (XNC1_2097), *Nocardioidaceae bacterium* Broad-1 (NBCG_02556), *Hoeflea phototrophica* DFL-43 (HPDFL43_16047), *Paracoccus* sp. TRP (PATRP_010100008956), *Cyanothece* sp. PCC 8801 (PCC8801_1952), *Shewanella sediminis* HAW-EB3 (SSED_2803), *Methylobacterium* sp. 4-46 (M446_3603, M446_0933), *Methylobacterium radiotolerans* JCM 2831 (MRAD2831_4824), *Azorhizobium caulinodans* ORS 571 (AZC_1945), *Ochrobactrum anthropi* ATCC 49188 (OANT_3311), *Ruegeria* sp. R11 (RR11_1621), *Cyanothece* sp. ATCC 51142 (CODA), *Streptomyces clavuligerus* ATCC 27064 (SCLAA2_010100026671, SCLAV_5539), *Lysinibacillus sphaericus* C3-41 (BSPH_4231), *Clostridium botulinum* NCTC 2916 (CODA), *Anaerotruncus colihominis* DSM 17241 3 seqs ANACOL_03998, ANACOL_02279, ANACOL_01309), *Actinosynnema mirum* DSM 43827 (AMIR_0538), *Sanguibacter keddieii* DSM 10542 (SKED_28020, SKED_17260), *Stackebrandtia nassauensis* DSM 44728 (SNAS_1703), *Microcystis aeruginosa* NIES-843 (MAE_05360), *Clostridium perfringens* NCTC 8239 (CODA), *Kitasatospora setae* KM-6054 (KSE_36300, KSE_36320), *Arthrobacter chlorophenolicus* A6 (ACHL_1061), *Streptomyces griseus* subsp. *griseus* NBRC 13350 (SGR_6458), *Clostridium* sp. 7_2_43FAA (CSBG_02087), *Clostridiales bacterium* 1_7_47FAA (CBFG_00901), *Streptomyces albus* J1074 (SSHG_05633), *Shewanella halifaxensis* HAW-EB4 (SHAL_2160), *Methylobacterium nodulans* ORS 2060 (MNOD_3349), *Streptomyces* sp. Mg1 (SSAG_05271), *Erwinia tasmaniensis* Et1/99 (CODA), *Escherichia coli* BL21(DE3) 4 seqs YAHJ, CODA, B21_00295, B21_00283), *Conexibacter woesei* DSM 14684 3 seqs CWOE_5700, CWOE_5704, CWOE_0344), *Citrobacter* sp. 30_2 (CSAG_03013, CSAG_02691), *Burkholderiales bacterium* 1_1_47 (HMPREF0189_01313), *Enterobacteriaceae bacterium* 9_2_54FAA (HMPREF0864_03568), *Fusobacterium ulcerans* ATCC 49185 (FUAG_02220), *Fusobacterium varium* ATCC 27725 (FVAG_00901), *Beutenbergia cavernae* DSM 12333 (BCAV_1683, BCAV_1451), *Providencia stuartii* ATCC 25827 (PROSTU_04183), *Proteus penneri* ATCC 35198 (PROPEN_03672), *Streptosporangium roseum* DSM 43021 (SROS_3184, SROS_4847), *Paenibacillus* sp. Y412MC10 3 seqs GYMC10_2692, GYMC10_4727, GYMC10_3398), *Escherichia coli* ATCC 8739 (YAHJ, CODA), *Ktedonobacter racemifer* DSM 44963 (KRAC_3038), *Marinomonas posidonica* IVIA-Po-181 (MAR181_2188), *Cyanothece* sp. PCC 7822 (CYAN7822_1898), *Edwardsiella tarda* EIB202 (CODA), *Providencia rustigianii* DSM 4541 (PROVRUST_05865), *Enterobacter cancerogenus* ATCC 35316 (ENTCAN_08376, ENTCAN_08631), *Citrobacter youngae* ATCC 29220 (CIT292_10672, CIT292_09697), *Citreicella* sp. SE45 (CSE45_2970), *Escherichia albertii* TW07627 (ESCAB7627_0317), *Oligotropha carboxidovorans* OM5 (OCAR_4627, CODA), *Escherichia coli* str. K-12 substr. MG1655 (YAHJ, CODA), *Lactobacillus buchneri* NRRL B-30929 (LBUC_2038), *Arthrospira maxima* CS-328 (AMAXDRAFT_2897), *Pantoea* sp. aB (PANABDRAFT_0565, PANABDRAFT_2938), *Eubacterium biforme* DSM 3989 (EUBIFOR_01772), *Providencia*

*alcalifaciens* DSM 30120 (PROVALCAL_01131, PROVALCAL_02804), *Providencia rettgeri* DSM 1131 (PROVRETT_08714, PROVRETT_08169), *Stenotrophomonas maltophilia* K279a (ATZC2), *Anaerococcus lactolyticus* ATCC 51172 (CODA), *Anaerococcus tetradius* ATCC 35098 (HMPREF0077_0097), *Chryseobacterium gleum* ATCC 35910 (DAN2), *Lactobacillus buchneri* ATCC 11577 (CODA), *Lactobacillus vaginalis* ATCC 49540 (CODA), *Listeria grayi* DSM 20601 (HMPREF0556_10753, HMPREF0556_10751, ATZC), *Desulfomicrobium baculatum* DSM 4028 (DBAC_2936), *Anaerococcus prevotii* DSM 20548 (APRE_1112), *Sebaldella termitidis* ATCC 33386 (STERM_0789), *Meiothermus silvanus* DSM 9946 (MESIL_2103), *Proteus mirabilis* HI4320 (CODA), *Mesorhizobium opportunistum* WSM2075 (MESOP_0162), *Variovorax paradoxus* S110 (VAPAR_2654), *Bacillus megaterium* QM B1551 (BMQ_0980), *Bifidobacterium pseudocatenulatum* DSM 20438=JCM 1200 (BIFPSEUDO_04382), *Ferrimonas balearica* DSM 9799 (FBAL_2173), *Ruminococcaceae bacterium* D16 (HMPREF0866_00501), *Photorhabdus asymbiotica* subsp. *asymbiotica* ATCC 43949 (PAU_00294), *Halothiobacillus neapolitanus* c2 (HNEAP_0844), *Haemophilus parasuis* SH0165 (CODA), *Dickeya zeae* Ech1591 (DD1591_0763), *Bilophila wadsworthia* 3_1_6 (HMPREF0179_03393), *Enterococcus gallinarum* EG2 (EGBG_00349), *Enterococcus casseliflavus* EC20 (ECBG_00307), *Spirochaeta smaragdinae* DSM 11293 (SPIRS_1052, SPIRS_0110), *Acinetobacter junii* SH205 (HMPREF0026_02783), *Vibrio splendidus* LGP32 (VS_II0327), *Dickeya dadantii* Ech703 (DD703_0777), *Moritella* sp. PE36 (PE36_15643), *Hirschia baltica* ATCC 49814 (HBAL_0036), *Aminomonas paucivorans* DSM 12260 (APAU_2064), *Weissella paramesenteroides* ATCC 33313 (CODA), *Dickeya dadantii* Ech586 (DD586_3388), *Streptomyces* sp. SPB78 (SSLG_06016), *Streptomyces* sp. AA4 (SSMG_05855, SSMG_03227), *Streptomyces viridochromogenes* DSM 40736 (SSQG_04727), *Streptomyces flavogriseus* ATCC 33331 (SFLA_1190), *Anaerobaculum hydrogeniformans* ATCC BAA-1850 (HMPREF1705_02256), *Pantoea* sp. At-9b (PAT9B_3678, PAT9B_1029, PAT9B_0855), *Variovorax paradoxus* EPS (VARPA_3257, VARPA_0920), *Prochlorococcus marinus* subsp. *pastoris* str. CCMP1986 (CODA), *Synechococcus* sp. WH 7805 (WH7805_05676), *Blattabacterium* sp. (*Periplaneta americana*) str. BPLAN (CODA), *Burkholderia glumae* BGR1 (BGLU_1G17900), *Azoarcus* sp. BH72 (CODA), *Clostridium butyricum* E4 str. BoNT E BL5262 (CODA), *Erwinia pyrifoliae* Ep1/96 (CODA), *Erwinia billingiae* Eb661 (EBC_35430, CODA, EBC_32850, EBC_32780), *Edwardsiella ictaluri* 93-146 (NT01EI_3615), *Citrobacter rodentium* ICC168 (CODA), *Starkeya novella* DSM 506 (SNOV_3614, SNOV_2304), *Burkholderia* sp. CCGE1001 (BC1001_2311), *Burkholderia* sp. CCGE1002 (BC1002_1908, BC1002_1610), *Burkholderia* sp. CCGE1003 (BC1003_1147), *Enterobacter asburiae* LF7a (ENTAS_4074, ENTAS_3370), *Ochrobactrum intermedium* LMG 3301 (OINT_2000395, OINT_2001541), *Clostridium lentocellum* DSM 5427 (CLOLE_1291), *Desulfovibrio aespoeensis* Aspo-2 (DAES_2101), *Gordonia neofelifaecis* NRRL B-59395 (SCNU_19677), *Synechococcus* sp. CC9311 (SYNC_0740), *Thermaerobacter marianensis* DSM 12885 (TMAR_1477), *Rhodomicrobium vannielii* ATCC 17100 (RVAN_3395), *Bacillus cellulosilyticus* DSM 2522 (BCELL_1091, BCELL_1234), *Cyanothece* sp. PCC 7424 (PCC7424_0235), *Lachnospiraceae bacterium* 3_1_57FAA_CT1 (HMPREF0994_04419), *Bacillus* sp. 2_A_57_CT2 (HMPREF1013_04901, HMPREF1013_04902, HMPREF1013_01532, HMPREF1013_04888), *Afipia* sp. 1NLS2 (AFIDRAFT_3092), *Bacillus clausii* KSM-K16 (ABC4032), *Serratia odorifera* DSM 4582 (YAHJ, CODA), *Vibrio alginolyticus* 40B (VMC_19080), *Pseudonocardia dioxanivorans* CB1190 (PSED_5383), *Vibrio corallilyticus* ATCC BAA-450 (VIC_002709), *Vibrio orientalis* CIP 102891=ATCC 33934 (VIA_000851), *Photobacterium damselae* subsp. *damselae* CIP 102761 (VDA_000799), *Prevotella buccalis* ATCC 35310 (HMPREF0650_2329), *Serratia odorifera* 4Rx13 (SOD_G01050, SOD_H00810), *Synechococcus* sp. WH 5701 (WH5701_16173, WH5701_07386), *Arthrospira platensis* NIES-39 (BAI89358.1), *Vibrio* sp. N418 (VIBRN418_08807), *Enterobacter cloacae* SCF1 (ENTCL_0362), *Pediococcus claussenii* ATCC BAA-344 (CODA), *Pantoea ananatis* LMG 20103 (CODA, YAHJ), *Bradyrhizobiaceae bacterium* SG-6C (CSIRO_2009), *Pantoea vagans* C9-1 (CODA, YAHJ), *Lactobacillus fermentum* CECT 5716 (LC40_0597), *Lactobacillus iners* AB-1 (LINEA_010100006044), *Lysinibacillus fusiformis* ZC1 (BFZC1_05123, BFZC1_05118), *Paenibacillus vortex* V453 (PVOR_16204, PVOR_25863), *Enterobacter cloacae* subsp. *cloacae* ATCC 13047 (ECL_04741, ECL_03997), *Marinomonas mediterranea* MMB-1 (MARME_0493), *Enterobacter cloacae* subsp. *cloacae* NCTC 9394 (ENC_29090, ENC_34640), *Rahnella* sp. Y9602 (RAHAQ_4063, RAHAQ_0278), *Achromobacter piechaudii* ATCC 43553 (HMPREF0004_2397, ATZC, CODA), *Sutterella wadsworthensis* 3_1_45B (HMPREF9464_00595), *Pseudomonas fulva* 12-X (PSEFU_1564), *Rahnella aquatilis* CIP 78.65=ATCC 33071 (AEX50243.1, AEX53933.1), *Prochlorococcus marinus* str. MIT 9312 (PMT9312_1400), *Prochlorococcus marinus* str. MIT 9313 (CODA), *Pseudomonas fluorescens* WH6 (YAHJ), *Clostridium ljungdahlii* DSM 13528 (CLJU_C19230), *Streptomyces bingchenggensis* BCW-1 (SBI_06150), *Amycolatopsis mediterranei* U32 (AMED_1997), *Microcoleus vaginatus* FGP-2 (MICVADRAFT_2986, MICVADRAFT_1253), *Ketogulonigenium vulgarum* WSH-001 (CODAB, KVU_1143), *Achromobacter xylosoxidans* A8 4 seqs AXYL_01223, AXYL_05738, AXYL_01981, CODA), *Pedobacter saltans* DSM 12145 (PEDSA_0106), *Mesorhizobium ciceri* biovar biserrulae WSM1271 (MESCI_0163), *Pseudomonas putida* GB-1 (PPUTGB1_2651, PPUTGB1_3590), *Xanthobacter autotrophicus* Py2 (XAUT_4058), *Synechococcus* sp. WH 8102 (CODA), *Corynebacterium variabile* DSM 44702 (CODA), *Agrobacterium* sp. H13-3 (AGROH133_09551), *Pediococcus acidilactici* DSM 20284 (CODA), *Haemophilus parainfluenzae* T3T1 (PARA_18250), *Weeksella virosa* DSM 16922 (WEEVI_1993), *Aerococcus urinae* ACS-120-V-Col10a (CODA), *Thermaerobacter subterraneus* DSM 13965 (THESUDRAFT_1163), *Aeromonas caviae* Ae398 (ACAVA_010100000636), *Burkholderia rhizoxinica* HKI 454 (RBRH_03808), *Salmonella enterica* subsp. *arizonae* serovar str. RSK2980 (SARI_04290), *Hylemonella gracilis* ATCC 19624 (HGR_11321), *Aggregatibacter segnis* ATCC 33393 (CODA), *Roseovarius nubinhibens* ISM (ISM_11230), *Plautia stali* symbiont (PSTAS_010100016161, PSTAS_010100013574), *Peptoniphilus harei* ACS-146-V-Sch2b (CODA), *Pseudovibrio* sp. FO-BEG1 (PSE_0768), *Weissella cibaria* KACC 11862 (WCIBK1_010100001529), *Synechococcus* sp. PCC 7335 (S7335_2052, S7335_109, S7335_1731), *Anaerolinea thermophila* UNI-1 (ANT_02950), *Prochlorococcus marinus* str. MIT 9211 (CODA), *Prochlorococcus marinus* str. MIT 9215 (CODA), *Fructobacillus fructosus* KCTC 3544 (FFRUK3_010100004834), *Lactobacillus farciminis* KCTC 3681 (LFARK3_010100001847), *Lactobacillus fructivorans* KCTC 3543 (LFRUK3_010100002075), *Tetragenococcus halophilus* NBRC 12172 3 seqs TEH_05430, TEH_14850, TEH_02220), *Vibrio brasiliensis* LMG 20546 (VIBR0546_14545), *Cupriavidus taiwanensis* LMG 19424 (CODA), *Microbacterium testaceum* StLB037 (MTES_1247, MTES_3600), *Paenibacillus terrae* HPL-003 (HPL003_22070), *Rubrivivax benzoatilyticus* JA2 (RBXJA2T_04743), *Polymorphum gilvum* SL003B-26A1 (SL003B_2461), *Salmonella enterica* subsp. *enterica* serovar *Typhimurium* str. LT2 (STM3334), *Streptomyces griseoaurantiacus* M045 (SGM_3210), *Aeromonas veronii* B565 (B565_3987), *Halomonas* sp. TD01 (GME_08209), *Burkholderia gladioli* BSR3 (BGLA_2G13660).

In some embodiments, the genetically engineered bacteria are administered intratumorally and 5-FC is administered systemically. In some embodiments, both the genetically engineered bacteria and 5-FC are administered systemically.

In any of these embodiments, the bacteria genetically engineered to produce 5-FU from 5-FC 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more 5-FU than unmodified bacteria of the same bacterial subtype under the same conditions, e.g., under in vitro or in vivo conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more 5-FU than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more 5-FU than unmodified bacteria of the same bacterial subtype under the same conditions, e.g. under in vitro or in vivo conditions.

In any of these embodiments, the bacteria genetically engineered to produce 5-FU consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% or more increased amounts of 5-FC than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more 5-FC than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold or more increased amounts of 5-FC than unmodified bacteria of the same bacterial subtype under the same conditions.

In any of these 5-FC to 5-FU conversion embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria comprise a gene sequence encoding CodA. In one embodiment, the CodA gene has at least about 80% identity with a SEQ ID NO: 1213. In another embodiment, the CodA gene has at least about 85% identity with SEQ ID NO: 1213. In one embodiment, the CodA gene has at least about 90% identity with SEQ ID NO: 1213. In one embodiment, the CodA gene has at least about 95% identity with SEQ ID NO: 1213. In another embodiment, the CodA gene has at least about 96%, 97%, 98%, or 99% identity with SEQ ID NO: 1213. Accordingly, in one embodiment, the CodA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 1213. In another embodiment, the CodA gene comprises the sequence of SEQ ID NO: 1213. In yet another embodiment, the CodA gene consists of the sequence of SEQ ID NO: 1213.

In some embodiments, the genetically engineered bacteria comprise a gene sequence encoding a CodA polypeptide having at least about 80% identity with SEQ ID NO: 1216 OR SEQ ID NO: 1217. In some embodiments, the genetically engineered bacteria comprise a gene sequence encoding a CodA polypeptide that has about having at least about 90% identity with SEQ ID NO: 1216 OR SEQ ID NO: 1217. In some embodiments, the genetically engineered bacteria comprise a gene sequence encoding a CodA polypeptide that has about having at least about 95% identity with SEQ ID NO: 1216 OR SEQ ID NO: 1217. In some embodiments, the genetically engineered bacteria comprise a gene sequence encoding a CodA polypeptide that has about 80%, 81%, 82%, 83%, 84%, 85%, 86%, 87%, 88%, 89%, 90%, 91%, 92%, 93%, 94%, 95%, 96%, 97%, 98%, or 99% identity to SEQ ID NO: 1216 OR SEQ ID NO: 1217, or a functional fragment thereof. In another embodiment, the genetically engineered bacteria comprise a gene sequence encoding a CodA polypeptide comprising SEQ ID NO: 1216 OR SEQ ID NO: 1217. In yet another embodiment, the polypeptide expressed by the genetically engineered bacteria consists of SEQ ID NO: 1216 OR SEQ ID NO: 1217.

In some embodiments, cytosine deaminases are modified and/or mutated, e.g., to enhance stability, or to increase 5-FU production. In some embodiments, the genetically engineered bacteria and/or other microorganisms are capable of producing the cytosine deaminases under inducing conditions, e.g., under a condition(s) associated with immune suppression and/or tumor microenvironment. In some embodiments, the genetically engineered bacteria and/or other microorganisms are capable of producing the cytosine deaminases in low-oxygen conditions or hypoxic conditions, in the presence of certain molecules or metabolites, in the presence of molecules or metabolites associated with cancer, or certain tissues, immune suppression, or inflammation, or in the presence of some other metabolite that may or may not be present in the gut, circulation, or the tumor, such as arabinose.

In some embodiments, the genetically engineered bacteria encode cytosine deaminases from *E coli*. In some embodiments, cytosine deaminase from *E. coli* is modified and/or mutated, e.g., to enhance stability, or to increase 5-FU production. In some embodiments, the genetically engineered bacteria and/or other microorganisms are capable of producing the cytosine deaminases under inducing conditions, e.g., under a condition(s) associated with immune suppression and/or tumor microenvironment. In some embodiments, the genetically engineered bacteria and/or other microorganisms are capable of producing cytosine deaminase, in low-oxygen conditions or hypoxic conditions, in the presence of certain molecules or metabolites, in the presence of molecules or metabolites associated with cancer, or certain tissues, immune suppression, or inflammation, or in the presence of some other metabolite that may or may not be present in the gut, circulation, or the tumor, such as arabinose.

In some embodiments, the genetically engineered bacteria and/or other microorganisms are capable of expressing any one or more of the described circuits, including but not limited to, circuitry for the expression of cytosine deaminases, from *E. coli*, in low-oxygen conditions, and/or in the presence of cancer and/or the tumor microenvironment and/or the tumor microenvironment or tissue specific molecules or metabolites, and/or in the presence of molecules or metabolites associated with inflammation or immune suppression, and/or in the presence of metabolites that may be present in the gut or the tumor, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during bacteria and/or other microorganisms expansion, production and/or manufacture, as described herein.

In any of these embodiments, any one or more of the described circuits, including but not limited to, circuitry for the expression of cytosine deaminases, e.g., from *Listeria monocytogenes*, are present on one or more plasmids (e.g., high copy or low copy) or are integrated into one or more sites in the bacteria and/or other microorganism chromosome(s). Also, in some embodiments, the genetically engineered bacteria and/or other microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art (7) one or more circuits for the production or degradation of one or more metabolites (e.g., kynurenine, tryptophan, adenosine, arginine) described herein and (8) combinations of one or more of such additional circuits. In any of these embodiments, the genetically engineered bacteria may be administered alone or in combination with one or more immune checkpoint inhibitors described herein, including but not limited to anti-CTLA4 antibodies or anti-PD1 or anti-PDL1 antibodies.

Combination Circuits—Combinations of Anti-Cancer Molecules

In some embodiments, one or more microorganisms are genetically engineered to express gene sequence(s) encoding one or more immunomodulatory effectors or combinations of two or more these effectors. Such gene sequences include but are not limited to gene sequences for the production or catabolism of certain metabolites in the tumor microenvironment, and/or polypeptides for secretion or display on the microorganism cell surface, including but not limited to cytokines, antibodies, e.g., immune checkpoint inhibitors, and other anti-cancer molecules described herein. Such gene sequences can be located on a plasmid in the microorganism or can be integrated into the chromosome or both. In certain embodiments, the one or more gene sequences are under the control of inducible promoters known in the art or described herein. For example, such inducible promoters may be induced under low-oxygen conditions, such as an FNR promoter. In other embodiments, the promoters are induced in the presence of certain molecules or metabolites, e.g., in the presence of molecules or metabolites associated with the tumor microenvironment and/or with immune suppression. In some embodiments, the promoters are induced in certain tissue types. In some embodiments, promoters are induced in the presence of certain gut-specific or tumor-specific molecules or metabolites. In some embodiments, the promoters are induced in the presence of some other metabolite that may or may not be present in the gut or the tumor, such as arabinose or another chemical or nutritional inducer known in the art or described herein. In certain embodiments, the one or more cassettes are under the control of constitutive promoters described herein or known in the art, e.g., whose expression can be fine-tuned using ribosome binding sites of different strengths. Such microorganisms optionally also comprise an auxotrophy, e.g., an amino acid auxotrophy or a nucleotide auxotrophy, such as deltaDapA or deltaThyA.

In embodiments, the genetically engineered bacteria are capable of producing two or more immune modulators that modulate T effector cells, e.g., CD4+ and CD8+ cells. In some embodiments, the genetically engineered bacteria are capable of producing two or more immune modulators that activate, stimulate, and/or induce the differentiation of T effector cells, e.g., CD4+ and CD8+ cells. In some embodiments, the immune modulators are cytokines that activate, stimulate, and/or induce the differentiation of T effector cells, e.g., CD4+ and CD8+ cells.

In some embodiments, the genetically engineered bacteria are capable of producing two or more cytokines selected from IL-2, IL-15, IL-12, IL-7, IL-21, and IL-18. For example, in some embodiments, the genetically engineered bacteria comprise nucleic acid sequence(s) encoding two or more cytokines selected from IL-2, IL-15, IL-12, IL-7, IL-21, and IL-18. In some embodiments, the genetically engineered bacteria comprise nucleic acid sequence(s) encoding IL-2 and IL-15. In alternate embodiments, the disclosure provides a composition comprising a combination (e.g., two or more) of different genetically engineered bacteria, each bacteria encoding a different immune modulator. For example, in some embodiments, the composition comprises a genetically engineered bacteria comprising nucleic acid sequence(s) encoding IL-2 and a genetically engineered bacteria comprising nucleic acid sequence(s) encoding IL-15.

In some embodiments, the genetically engineered bacteria comprise nucleic acid sequence(s) encoding two or more agonists selected from CD40, CD28, ICOS, CD226, CD137 (4-1BB), and OX40, agonists, such as any of the CD40, CD28, ICOS, CD226, CD137 (4-1BB), and OX40 agonists disclosed herein. In some embodiments, the genetically engineered bacteria comprise nucleic acid sequence(s) encoding one or more cytokines selected from IL-2, IL-15, IL-12, IL-7, IL-21, and IL-18 and nucleic acid sequence(s) encoding one or more agonists selected from CD40, CD28, ICOS, CD226, CD137 (4-1BB), and OX40, agonists, such as any of the CD40, CD28, ICOS, CD226, CD137 (4-1BB), and OX40 agonists disclosed herein. In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and a genetically engineered bacteria comprising nucleic acid sequence(s) encoding one or more agonists selected from CD40, CD28, ICOS, CD226, CD137 (4-1BB), and OX40, agonists.

In some embodiments, the genetically engineered bacteria comprise nucleic acid sequence encoding GM-CSF and nucleic acid sequence encoding another immune modulator that promotes dendritic cell activation. In some embodiments, the genetically engineered bacteria comprise nucleic acid sequence(s) encoding one or more immune modulators that promote dendritic cell activation, e.g., GM-CSF and one or more agonists selected from CD40, CD28, ICOS, CD226, CD137 (4-1BB), and OX40, agonists, such as any of the CD40, CD28, ICOS, CD226, CD137 (4-1BB), and OX40 agonists disclosed herein. In some embodiments, the genetically engineered bacteria comprise nucleic acid sequence(s) encoding one or more immune modulators that promote dendritic cell activation, e.g., GM-CSF and nucleic acid sequence encoding one or more cytokines selected from IL-2, IL-15, IL-12, IL-7, IL-21, and IL-18. In some embodiments, the genetically engineered bacteria comprise nucleic acid sequence(s) encoding one or more immune modulators that promote dendritic cell activation, e.g., GM-CSF, nucleic acid sequence(s) encoding one or more cytokines selected from IL-2, IL-15, IL-12, IL-7, IL-21, and IL-18, and nucleic acid sequence(s) encoding one or more agonists selected from CD40, CD28, ICOS, CD226, CD137 (4-1BB), and OX40, agonists, such as any of the CD40, CD28, ICOS, CD226, CD137 (4-1BB), and OX40 agonists disclosed herein.

In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more agonists selected from CD40, CD28, ICOS, CD226, CD137 (4-1BB), and OX40, agonists and genetically engineered bacteria comprising nucleic acid sequence(s) encoding one or more immune modulators that promote dendritic cell activation, e.g., GM-CSF. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more immune modulators that promote dendritic cell activation, e.g., GM-CSF. In some embodiments, the composition comprises a genetically engineered bacteria comprising nucleic acid sequence(s) encoding one or more agonists selected from CD40, CD28, ICOS, CD226, CD137 (4-1BB), and OX40, agonists and genetically engineered bacteria comprising nucleic acid sequence(s) encoding one or more immune modulators that promote dendritic cell activation, e.g., GM-CSF. In some embodiments, the genetically engineered bacteria are capable of producing two or more immunomodulators that inhibit immune suppressor molecules, e.g., immune checkpoint molecules. In some embodiments, the genetically engineered bacteria are capable of producing two or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. For example, in some embodiments, the genetically engineered bacteria comprise nucleic acid sequence(s) encoding two or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In some embodiments, the genetically engineered bacteria comprise nucleic acid sequence(s) encoding single chain antibodies against CTLA-4 and PD-1.

In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria are capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors. In some embodiments, the composition comprises genetically engineered bacteria comprising nucleic acid sequence(s) encoding one or more agonists selected from CD40, CD28, ICOS, CD226, CD137 (4-1BB), and OX40 agonists and genetically engineered bacteria are capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors. In some embodiments, the composition comprises genetically engineered bacteria comprising nucleic acid sequence(s) encoding one or more cytokines selected from IL-2, IL-15, IL-12, IL-7, IL-21, and IL-18 and genetically engineered bacteria comprising nucleic acid sequence(s) encoding one or more agonists selected from CD40, CD28, ICOS, CD226, CD137 (4-1BB), and OX40 agonists and genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors.

In some embodiments, the genetically engineered bacteria are capable of producing two or more immune modulators that inhibit immune suppressors molecules, e.g., T regulatory cells, or Tregs. In some embodiments, the genetically engineered bacteria are capable of producing tryptophan and also metabolizing or degrading kynurenine. In some embodiments, the genetically engineered bacteria comprise a tryptophan operon, e.g., the tryptophan operon of E. coli or the tryptophan operon of B. subtilis and sequence encoding the enzyme kynureninase. In some embodiments, the genetically engineered bacteria comprise sequence(s) encoding trpE, trpG-D, trpC-F, trpB, and trpA genes and sequence encoding the enzyme kynureninase. In some embodiments, the genetically engineered bacteria comprise sequence(s) encoding trpE, trpD, trpC, trpF, trpB, and trpA genes and sequence encoding the enzyme kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

In alternate embodiments, the disclosure provides a composition comprising a combination (e.g., two or more) of different genetically engineered bacteria, each bacteria encoding a different immune modulator. In some embodiments, the composition comprises a genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors and genetically engineered bacteria capable of producing tryptophan and/or metabolizing or degrading kynurenine. In some embodiments, the composition comprises genetically engineered bacteria comprising nucleic acid sequence(s) encoding one or more agonists selected from CD40, CD28, ICOS, CD226, CD137 (4-1BB), and OX40 agonists and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine. In some embodiments, the composition comprises genetically engineered bacteria capable of producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, genetically engineered bacteria comprising nucleic acid sequence(s) encoding one or more cytokines selected from IL-2, IL-15, IL-12, IL-7, IL-21, and IL-18 and genetically engineered bacteria capable of producing tryptophan and/or metabolizing or degrading kynurenine and genetically engineered bacteria comprising nucleic acid sequence(s) encoding one or more agonists selected from CD40, CD28, ICOS, CD226, CD137 (4-1BB), and OX40 agonists.

In some embodiments, the genetically engineered bacteria are capable of producing two or more immune modulators that inhibit immune suppressors molecules, e.g., immune checkpoints and Tregs. In some embodiments, the genetically engineered bacteria are capable of producing tryptophan and also produce one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise sequence(s) encoding trpE, trpG-D, trpCtrpC-F, trpB, and trpA genes or sequence(s) encoding trpE, trpD, trpC, trpF, trpB, and trpA genes and nucleic acid sequence(s) encoding one or more single-chain antibodies against any checkpoint molecules selected from CTLA-4, PD-1, PD-L1, TIGIT, VISTA, LAG-3, TIN/11, TIM3, CEACAM1, LAIR-1, HVEM, BTLA, CD160, CD200, CD200R, and A2aR molecules. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

In alternate embodiments, the disclosure provides a composition comprising a combination (e.g., two or more) of different genetically engineered bacteria, each bacteria encoding a different immune modulator. In some embodiments, the composition comprises genetically engineered bacteria capable of producing tryptophan and genetically engineered bacteria capable of producing one or more immune checkpoint inhibitors selected from PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors.

In some embodiments, the genetically engineered bacteria are capable of metabolizing kynurenine and also producing one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise nucleic acid sequence encoding kynureninase and nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In alternate embodiments, the disclosure provides a composition comprising a combination (e.g., two or more) of different genetically engineered bacteria, each bacteria encoding a different immune modulator. In some embodiments, the composition comprises genetically engineered bacteria comprising nucleic acid sequence encoding kynureninase and genetically engineered bacteria comprising nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules.

In some embodiments, the genetically engineered bacteria are capable of producing tryptophan, metabolizing kynurenine, and also produce one or more immune checkpoint inhibitors selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR checkpoint inhibitors, such as any of the immune checkpoint inhibitors disclosed herein. In some embodiments, the genetically engineered bacteria comprise sequence(s) encoding trpE, trpG-D, trpC-F, trpB, and trpA genes or sequence(s) encoding trpE, trpD, trpC, trpF, trpB, and trpA genes, nucleic acid sequence encoding kynureninase, and nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

In any of the above combination embodiments, the bacterium further comprises gene sequence(s) for encoding a secretion system to secrete the one or more anti-cancer molecules from the bacterium. In any of the above combination embodiments, the secretion system is selected from the modified type III flagellar, type I (e.g., hemolysin secretion system), type II, type IV, type V, type VI, and type VII secretion systems, resistance-nodulation-division (RND) multi-drug efflux pumps, a single membrane secretion system, Sec and, TAT secretion systems. In any of the above combination embodiments, the genetically engineered bacterium further comprises gene sequence(s) encoding a secretion system for exporting tryptophan from the bacterium. In any of the above combination embodiments, the bacterium comprises one or more gene sequence(s) encoding YddG. In any of the above combination embodiments, the genetically engineered bacterium further comprises gene sequence(s) encoding a transporter for importing kynurenine into the bacterium. In any of the above combination embodiments, the bacterium comprises one or more copies of a gene sequence selected from aroP, tnaB, and mtr genes.

In any of the above combination embodiments, the engineered microorganisms are also capable of depleting adenosine from the tumor site. In any of the above combination embodiments, the bacterium comprises one or more gene(s) or a gene cassette comprising one or more genes for depleting adenosine from the intratumoral site. In any of the above combination embodiments, the bacterium comprises a gene cassette comprising one or more genes for converting adenosine to urate. In any of the above combination embodiments, the genetically engineered bacterium comprises gene sequence(s) encoding one or more copies of add, xapA, deoD, xdhA, xdhB, and xdhC genes. In any of the above combination embodiments, the bacterium comprises gene sequence(s) encoding a transporter for importing adenosine into the bacterium. In any of the above combination embodiments, the bacterium comprises gene sequence(s) for encoding a nucleoside transporter, e.g., an adenosine transporter. In any of the above combination embodiments, the genetically engineered bacterium comprises gene sequence(s) for encoding one or more copies of nupG or nupC from E. coli. In any of the above combination embodiments, the bacterium comprises one or more gene(s) or a gene cassette comprising one or more biosynthetic genes for synthesizing arginine. In any of the above combination embodiments, the bacterium comprises gene sequence(s) encoding one or more arginine biosynthesis genes selected from argA, argB, argC, argD, argE, argF, argG, argH, argI, argJ, carA, and carB. In any of the above combination embodiments for producing arginine, an arginine repressor (argR) is deleted, mutated, or modified so as to diminish or obliterate its repressor function. In any of the above combination embodiments for producing arginine, the bacterium comprises a gene encoding feedback resistant argA. In any of the above combination embodiments, the genetically engineered bacterium produce a cytotoxin or a lytic peptide. In any of the above combination embodiments, the gene sequence(s) for producing the one or more anti-cancer molecules and operatively linked promoter are present on a chromosome in the bacterium. In any of the above combination embodiments, the gene sequence(s) for producing the one or more anti-cancer molecules and operatively linked promoter are present on a plasmid in the bacterium. In any of the above combination embodiments, the bacterium is an auxotroph comprising a deletion or mutation in a gene required for cell survival and/or growth, e.g., wherein the gene is selected from thyA, dapD, and dapA. In any of the above combination embodiment, the genetically engineered bacterium comprises a kill switch. In some embodiments, the disclosure provides a composition comprising engineered bacteria comprising gene(s) or a gene cassette comprising one or more genes for depleting adenosine and genetically engineered bacteria capable of producing tryptophan and/or metabolizing or degrading kynurenine, e.g., bacteria comprising nucleic acid sequence encoding kynureninase. In some embodiments, the composition further comprises engineered bacteria comprising nucleic acid sequence(s) encoding one or more single-chain antibodies against any checkpoint molecules selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR molecules. In some embodiments, the composition further comprises genetically engineered bacteria comprising nucleic acid sequence(s) encoding one or more agonists selected from CD40, CD28, ICOS, CD226, CD137 (4-1BB), and OX40 agonists. In some embodiments, the composition further comprises genetically engineered bacteria comprising nucleic acid sequence(s) encoding one or more cytokines selected from IL-2, IL-15, IL-12, IL-7, IL-21, and IL-18. In some embodiments, the composition further comprises genetically engineered bacteria capable of producing arginine.

In some embodiments, the genetically engineered bacteria are capable of producing one or more immune modulators that activate, stimulate, and/or induce the differentiation of T effector cells, e.g., CD4+ and CD8+ cells and also producing one or more immune modulators that inhibit immune suppressors molecules, e.g., immune checkpoints and Tregs. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding a single-chain antibody against CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells and are also capable of producing tryptophan, e.g., comprise a tryptophan operon, for example the tryptophan operon of E. coli or the tryptophan operon of B. subtilis. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding trpE, trpG-D, trpC-F, trpB, and trpA genes. In some embodiments, the genetically engineered bacteria comprise nucleic acid sequence(s) encoding one or more immune modulators that activate, stimulate, and/or induce the differentiation of T effector cells, e.g., CD4+ and CD8+ cells and nucleic acid sequence encoding trpE, trpD, trpC, trpF, trpB, and trpA genes. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding trpE, trpG-D, trpC-F, trpB, and trpA genes or trpE, trpD, trpC, trpF, trpB, and trpA genes and optionally may comprise a deleted or mutated tryptophan repressor (trpR) and/or optionally comprise gene sequence(s) to produce the tryptophan precursor, Chorismate, e.g., sequence(s) encoding aroG, aroF, aroH, aroB, aroD, aroE, aroK, and AroC. In any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding trpE, trpG-D, trpC-F, trpB, and trpA genes or trpE, trpD, trpC, trpF, trpB, and trpA genes, and nucleic acid sequence encoding one or more single-chain antibodies against any checkpoint molecule, for example, CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells and are also capable of metabolizing or degrading kynurenine, e.g., comprise sequence encoding the enzyme kynureninase. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15 and nucleic acid sequence encoding kynureninase. In any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding kynureninase, and nucleic acid sequence encoding one or more single-chain antibodies against any checkpoint molecule, for example, CTLA-4 and/or PD-1.

In some embodiments, the genetically engineered bacteria comprise nucleic acid sequence(s) encoding one or more immune modulators that activate, stimulate, and/or induce the differentiation of T effector cells, e.g., CD4+ and CD8+ cells, are also capable of producing tryptophan, and can metabolize or degrade kynurenine. In some of these embodiments, the genetically engineered bacteria comprise a tryptophan operon, e.g., the tryptophan operon of E. coli or the tryptophan operon of B. subtilis and sequence encoding the enzyme kynureninase. In some embodiments, the genetically engineered bacteria comprise sequence(s) encoding trpE, trpG-D, trpC-F, trpB, and trpA genes and sequence encoding the enzyme kynureninase. In some embodiments, the genetically engineered bacteria comprise sequence(s) encoding trpE, trpD, trpC, trpF, trpB, and trpA genes and sequence encoding the enzyme kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. In any of these embodiments, the nucleic acid sequence(s) encoding one or more immune modulators that activate, stimulate, and/or induce the differentiation of T effector cells may be sequence encoding one or more cytokines selected from IL-2, IL-15, IL-12, IL-7, IL-21, and IL-18, sequence encoding one or more agonists selected from CD40, CD28, ICOS, CD226, CD137 (4-1BB), and OX40, agonists, and/or sequence encoding an immune modulator that promotes dendritic cell activation, e.g., GM-CSF. For example, in some embodiments, the genetically engineered bacteria comprise nucleic acid sequence encoding IL-2 and/or IL-15, nucleic acid sequence encoding trpE, trpG-D, trpC-F, trpB, and trpA genes or trpE, trpD, trpC, trpF, trpB, and trpA genes, nucleic acid sequence encoding kynureninase, and optionally may comprise a deleted or mutated tryptophan repressor (trpR) and/or optionally comprise gene sequence(s) to produce the tryptophan precursor, Chorismate, e.g., sequence(s) encoding aroG, aroF, aroH, aroB, aroD, aroE, aroK, and AroC. In a specific embodiment, the genetically engineered bacteria comprise nucleic acid sequence encoding IL-2, nucleic acid sequence encoding trpE, trpG-D, trpC-F, trpB, and trpA genes, and nucleic acid sequence encoding kynureninase. In a specific embodiment, the genetically engineered bacteria comprise nucleic acid sequence encoding IL-2, nucleic acid sequence encoding trpE, trpG-D, trpC-F, trpB, and trpA genes, nucleic acid sequence encoding kynureninase, nucleic acid sequence encoding aroG, aroF, aroH, aroB, aroD, aroE, aroK, and AroC genes, and optionally deleted or mutated tryptophan repressor (trpR). In another specific embodiment, the genetically engineered bacteria comprise nucleic acid sequence encoding IL-15, nucleic acid sequence encoding trpE, trpG-D, trpC-F, trpB, and trpA genes, and nucleic acid sequence encoding kynureninase. In another specific embodiment, the genetically engineered bacteria comprise nucleic acid sequence encoding IL-12, nucleic acid sequence encoding trpE, trpG-D, trpC-F, trpB, and trpA genes, and nucleic acid sequence encoding kynureninase. In another specific embodiment, the genetically engineered bacteria comprise nucleic acid sequence encoding a CD40 agonist, nucleic acid sequence encoding trpE, trpG-D, trpC-F, trpB, and trpA genes, and nucleic acid sequence encoding kynureninase. In another specific embodiment, the genetically engineered bacteria comprise nucleic acid sequence encoding IL-2, a CD40 agonist, nucleic acid sequence encoding trpE, trpG-D, trpC-F, trpB, and trpA genes, and nucleic acid sequence encoding kynureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC. Also, in any of these embodiments, the genetically engineered bacteria may further comprise nucleic acid sequence encoding one or more single-chain antibodies against any checkpoint molecule, for example a checkpoint molecule selected from CTLA-4, PD-1, PD-L1, TIGIT, VISTA, LAG-3, TIM1, TIM3, CEACAM1, LAIR-1, HVEM, BTLA, CD160, CD200, CD200R, and A2aR. Thus, in some embodiments, the genetically engineered bacteria comprise nucleic acid sequence encoding a cytokine, e.g., IL-2 and/or IL-15, nucleic acid sequence encoding trpE, trpG-D, trpC-F, trpB, and trpA genes or trpE, trpD, trpC, trpF, trpB, and trpA genes, nucleic acid encoding kynureninase, and nucleic acid sequence encoding one or more single-chain antibodies against any checkpoint molecule, for example, CTLA-4 and/or PD-1. In one specific embodiment, the genetically engineered bacteria comprise nucleic acid sequence encoding IL-2, nucleic acid sequence encoding trpE, trpG-D, trpC-F, trpB, and trpA genes, nucleic acid encoding kynureninase, and nucleic acid sequence encoding PD-1 or CTLA-4. In one specific embodiment, the genetically engineered bacteria comprise nucleic acid sequence encoding IL-15, nucleic acid sequence encoding trpE, trpG-D, trpC-F, trpB, and trpA genes, nucleic acid encoding kynureninase, and nucleic acid sequence encoding PD-1 or CTLA-4.

In any of the above combination embodiments, the engineered microorganisms are also capable of depleting adenosine from the tumor site. In any of the above combination embodiments, the bacterium comprises one or more gene(s) or a gene cassette comprising one or more genes for depleting adenosine from the intratumoral site. In any of the above combination embodiments, the bacterium comprises a gene cassette comprising one or more genes for converting adenosine to urate. In any of the above combination embodiments, the genetically engineered bacterium comprises gene sequence(s) encoding one or more copies of add, xapA, deoD, xdhA, xdhB, and xdhC genes. In any of the above combination embodiments, the bacterium comprises gene sequence(s) encoding a transporter for importing adenosine into the bacterium. In any of the above combination embodiments, the bacterium comprises gene sequence(s) for encoding a nucleoside transporter, e.g., an adenosine transporter. In any of the above combination embodiments, the genetically engineered bacterium comprises gene sequence(s) for encoding one or more copies of nupG or nupC from E. coli. In any of the above combination embodiments, the bacterium comprises one or more gene(s) or a gene cassette comprising one or more biosynthetic genes for synthesizing arginine. In any of the above combination embodiments, the bacterium comprises gene sequence(s) encoding one or more arginine biosynthesis genes selected from argA, argB, argC, argD, argE, argF, argG, argH, argI, argJ, carA, and carB. In any of the above combination embodiments for producing arginine, an arginine repressor (argR) is deleted, mutated, or modified so as to diminish or obliterate its repressor function. In any of the above combination embodiments for producing arginine, the bacterium comprises a gene encoding feedback resistant argA. In any of the above combination embodiments, the genetically engineered bacterium produce a cytotoxin or a lytic peptide.

In some embodiments, the genetically engineered bacteria comprise one or more gene sequence(s) encoding kynureninase (and optionally circuitry for the production of tryptophan described herein) and one or more gene sequences encoding enzymes for the conversion of adenosine to urate. In some embodiments, the genetically engineered bacteria comprise gene sequence(s) encoding kynureninase (and optionally circuitry for the production of tryptophan described herein) and further comprise gene sequence(s) encoding one or more copies of add, xapA, deoD, xdhA, xdhB, and xdhC and nupC. In some embodiments, the genetically engineered bacteria comprise gene sequence(s) encoding kynureninase (and optionally circuitry for the production of tryptophan described herein) and further comprise gene sequence(s) encoding one or more copies of add, xapA, deoD, xdhA, xdhB, and xdhC and nupG. In any of these embodiments, the genetically engineered bacteria may comprise tryptophan production circuitry. In some embodiments, optional tryptophan circuitry includes deletion of TrpE. In some embodiments, tryptophan production circuitry comprises one or more of trpE, trpD, trpC, trpB, trpA, aroG, aroF, aroH, aroB, aroD, aroE, aroK, and aroC or a combination thereof. In some embodiments, such tryptophan production circuitry comprises one or more of aroG (fbr), trpE(fbr), trpD, trpC, trpB, trpA and combinations thereof. In some embodiments, tryptophan production circuitry comprises one or more of aroG(fbr), serA(fbr), trpE (fbr), trpD, trpC, trpB, trpA or combinations thereof. In some embodiments, such tryptophan production circuitry comprises aroG(fbr), serA(fbr), trpE(fbr), trpD, trpC, trpB, trpA, YddG or combinations thereof. In some embodiments, tryptophan production circuitry comprises trpE, trpD, trpC, trpB, trpA and combinations thereof.

Figure 36:
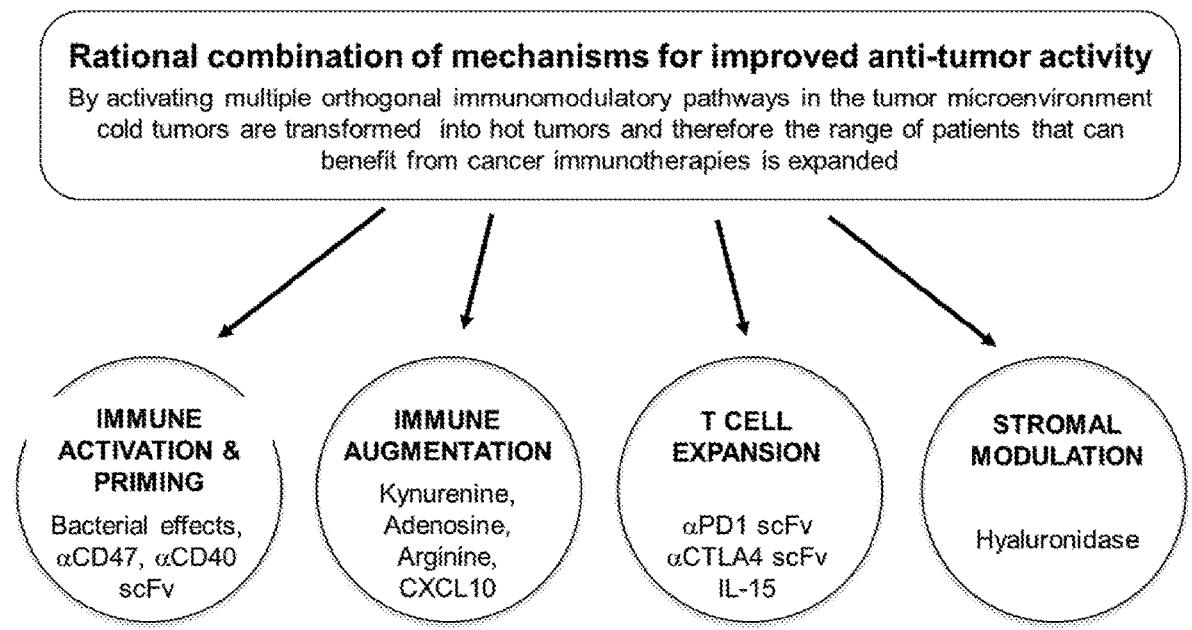
FIG. 36 depicts a schematic showing combinations of mechanisms for improved anti-tumor activity.
Figure 37:
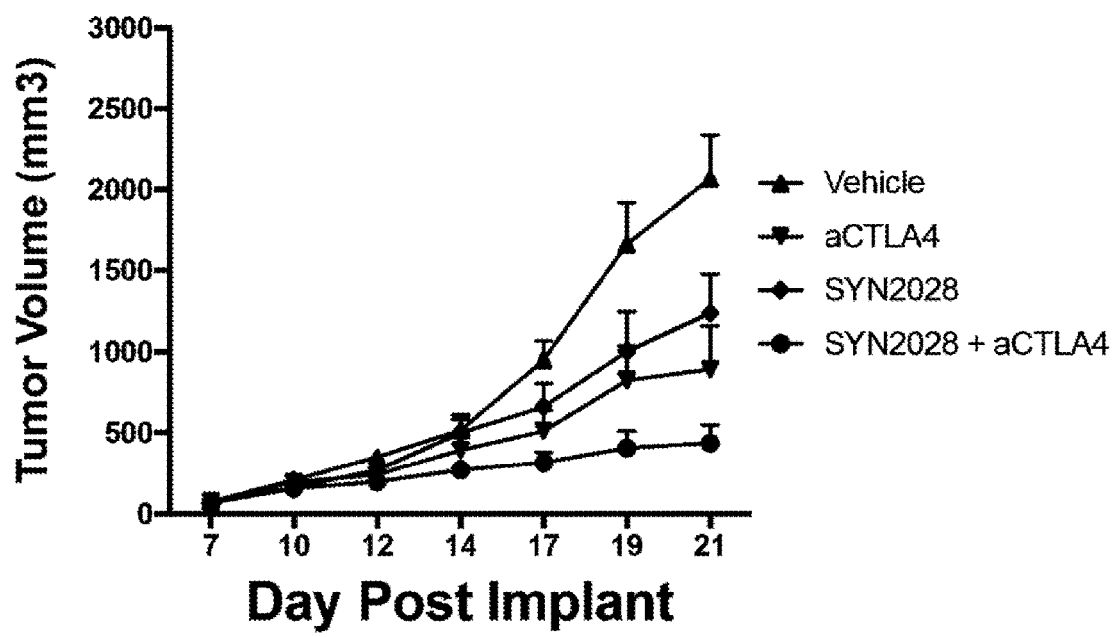
FIG. 37 depicts a line graph of an in vivo analysis of the effect of kynurenine consumption by kynurenine consuming strain SYN2028 carrying a constitutively expressed chromosomally integrated copy of Pseudomonas fluorescens kynureninase), alone or in combination with anti-CTLA4 antibody, compared to vehicle or anti-CTLA-4 antibody alone, on tumor volume. The data suggest anti-tumor activity of the kynurenine-consuming strain as single agent and in combination with anti-CTLA4 antibody, and that SYN2028 improves αCTL-4-mediated anti-tumor activity in CT26. In this study, BALB/c mice were implanted with CT26 tumors; anti-CTLA4 antibody was administered IP at 100 ug/mouse; Bacteria were administered intratumorally at $1 \times 10^{e7}$; bacteria and antibodies were all administered biweekly.
Figure 38A:
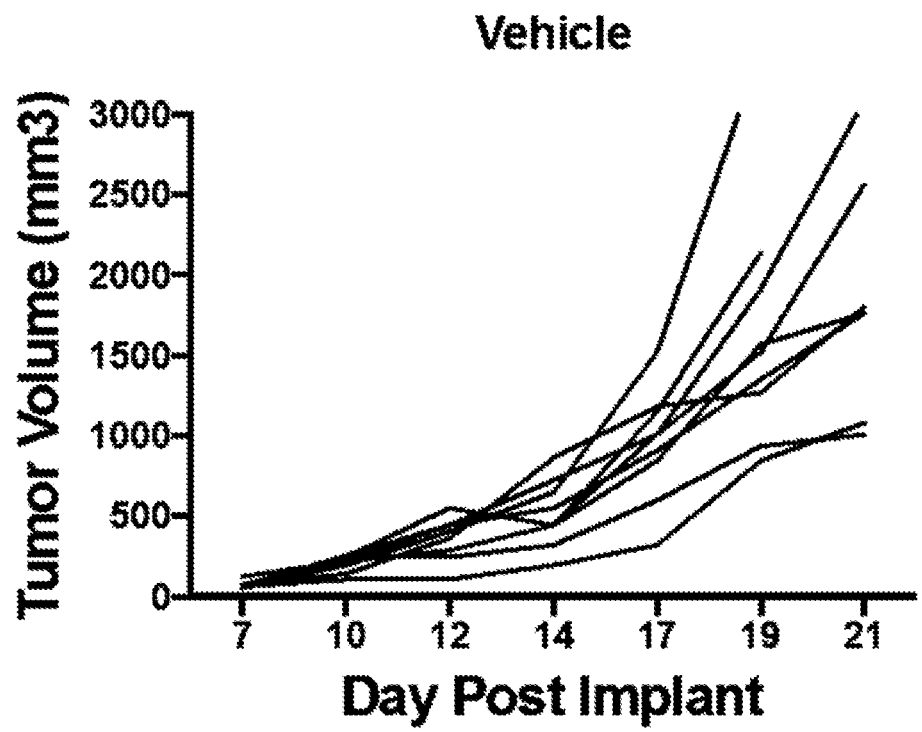
FIGS. 38A, 38B, 38C, and 38D depict line graphs showing each individual mouse for the study shown in FIG. 37.
Figure 38B:
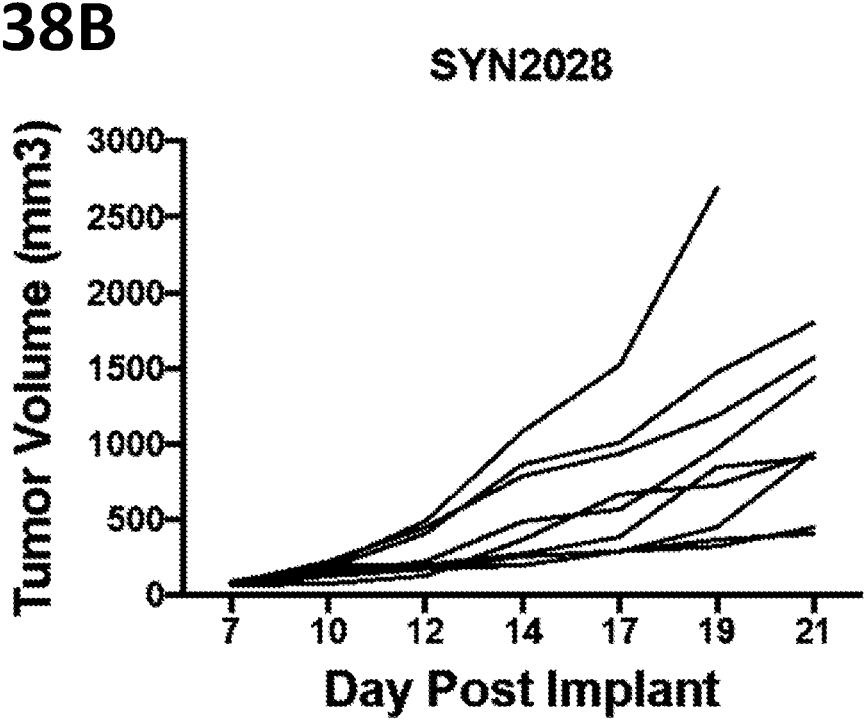
Figure 38C:
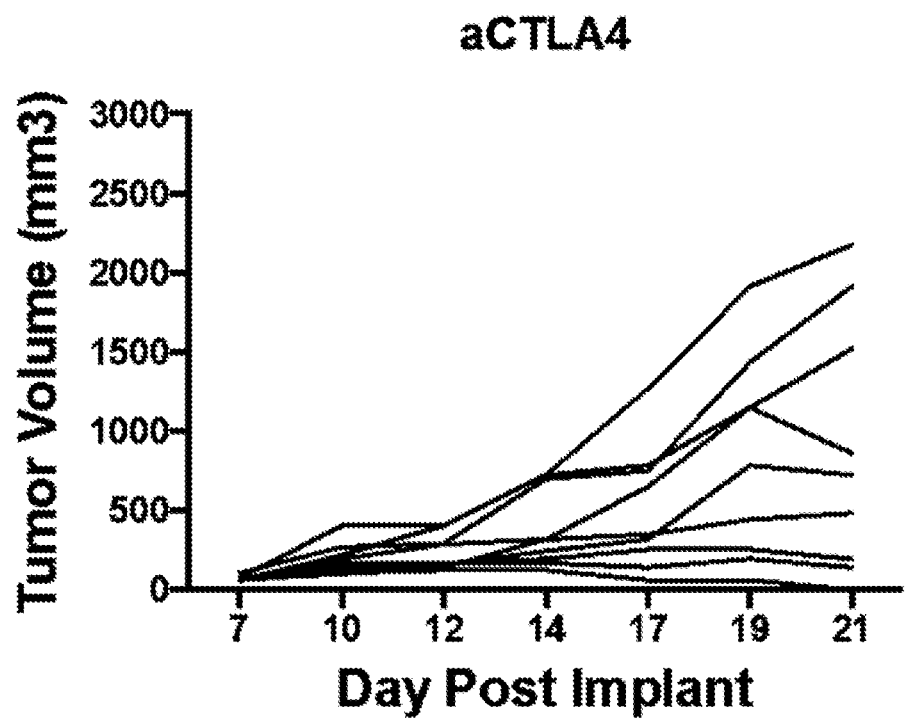
Figure 38D:
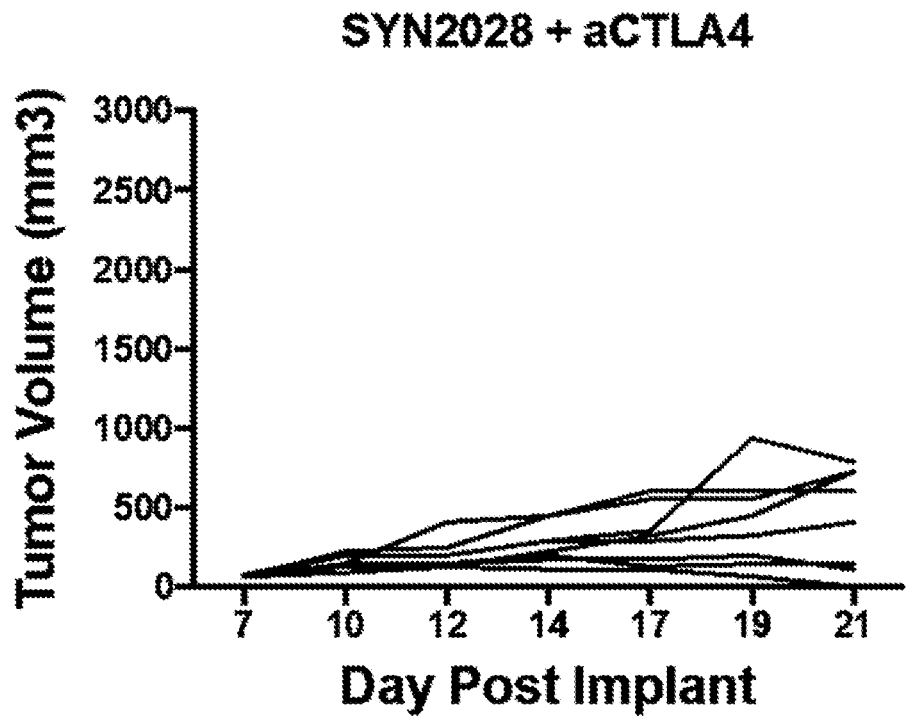
Figure 38E:
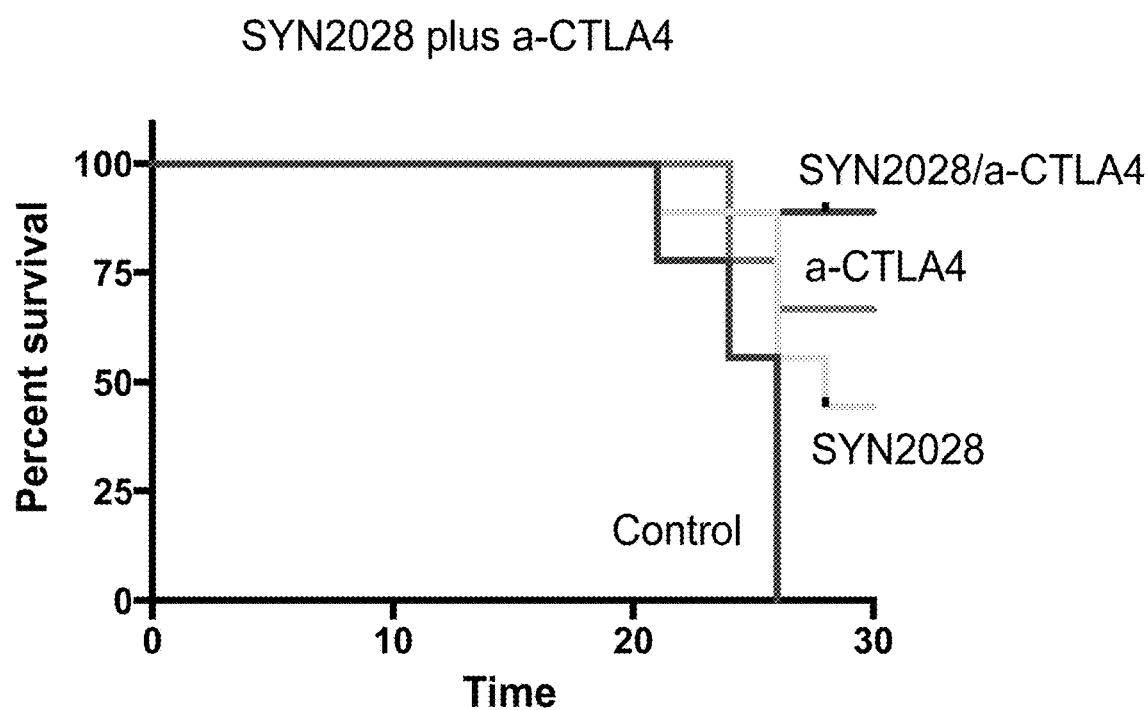
FIG. 38E depicts the corresponding Kaplan-Meier plot.
Figure 39A:
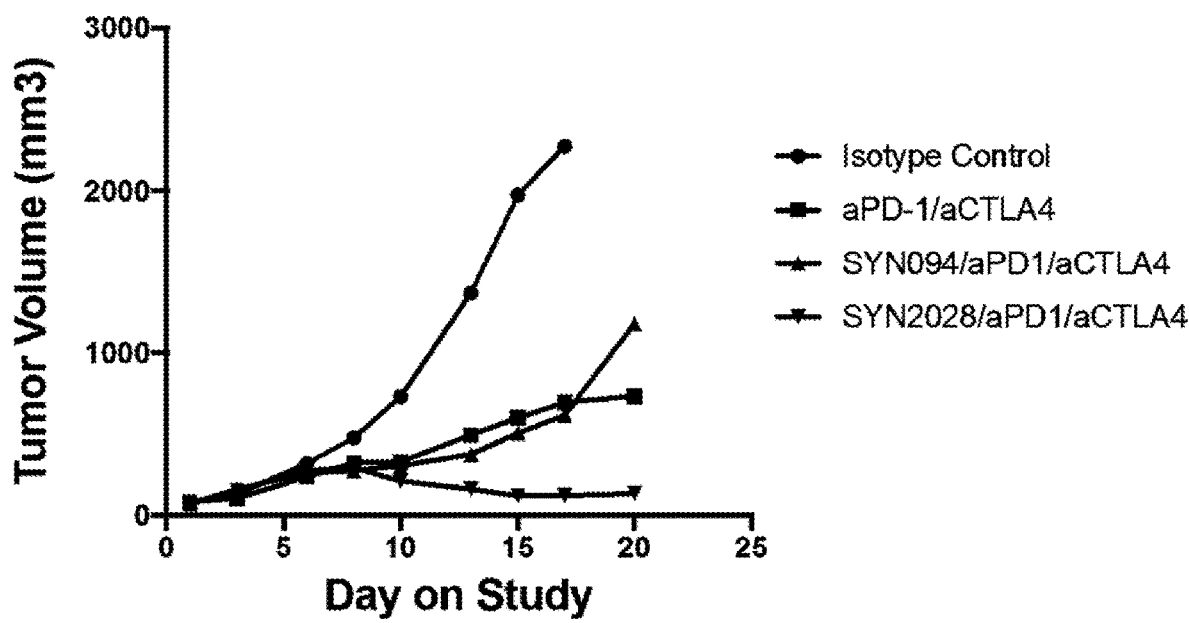
FIG. 39A, FIG. 39B, FIG. 39C, FIG. 39D, FIG. 39E depicts a line graphs showing showing that Kyn consumer SYN2028 in combination with αντιCTL-4 and anti-PD1 antibodies has improved anti-tumor activity in MC38 tumors.
Figure 39B:
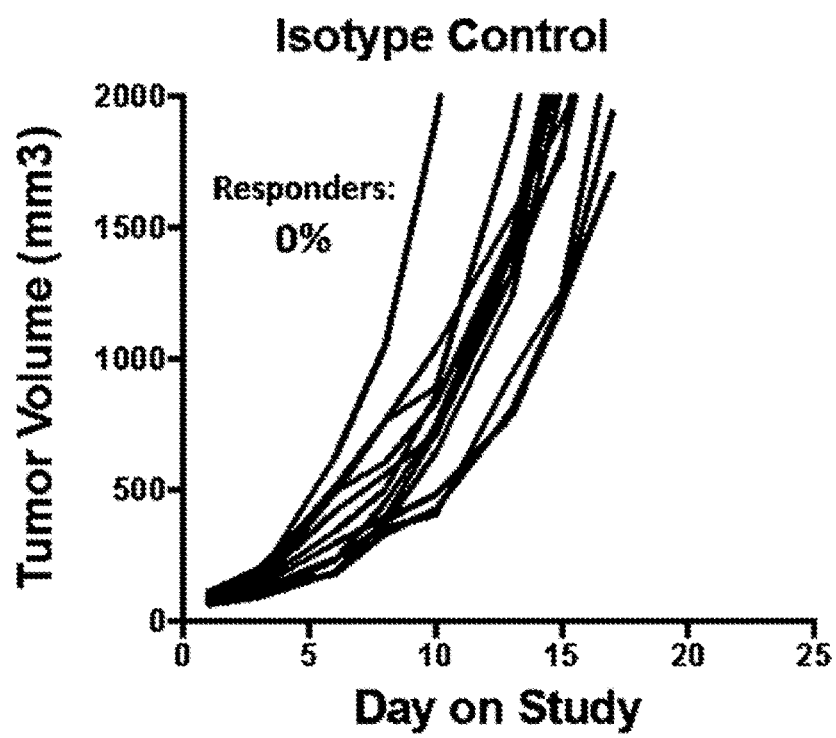
Figure 39C:
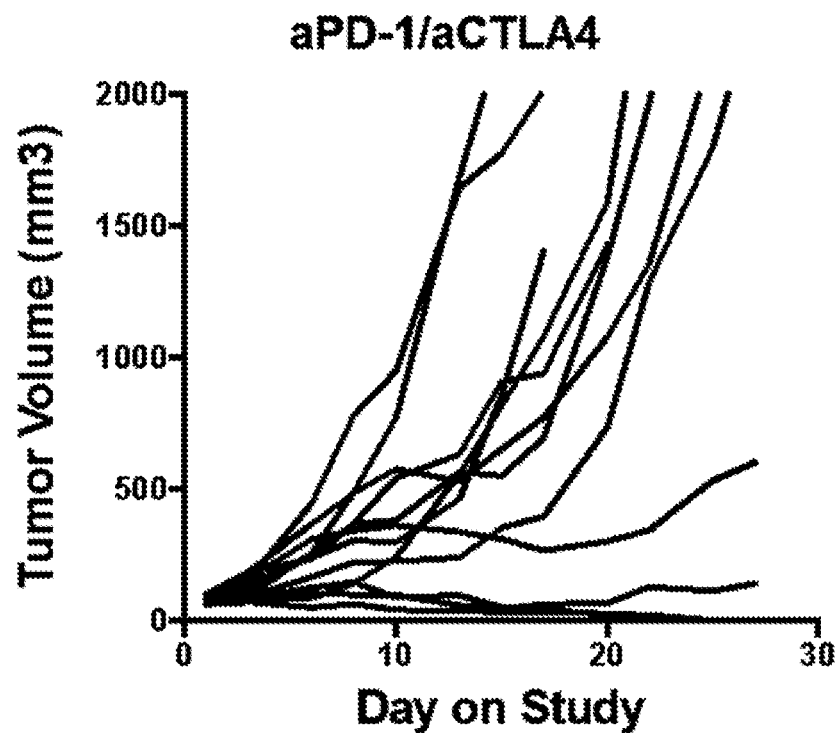
Figure 39D:
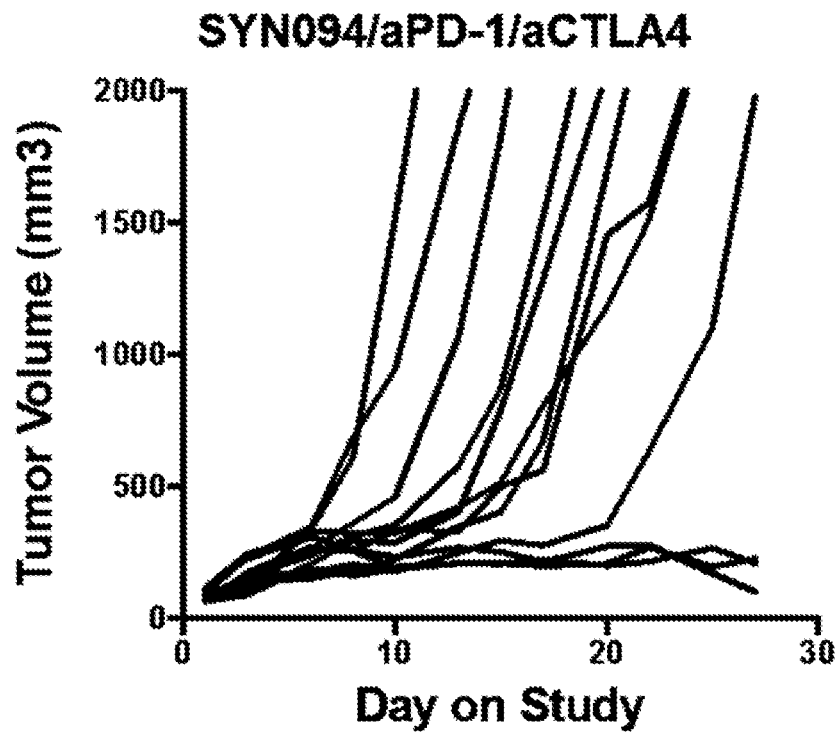
Figure 39E:
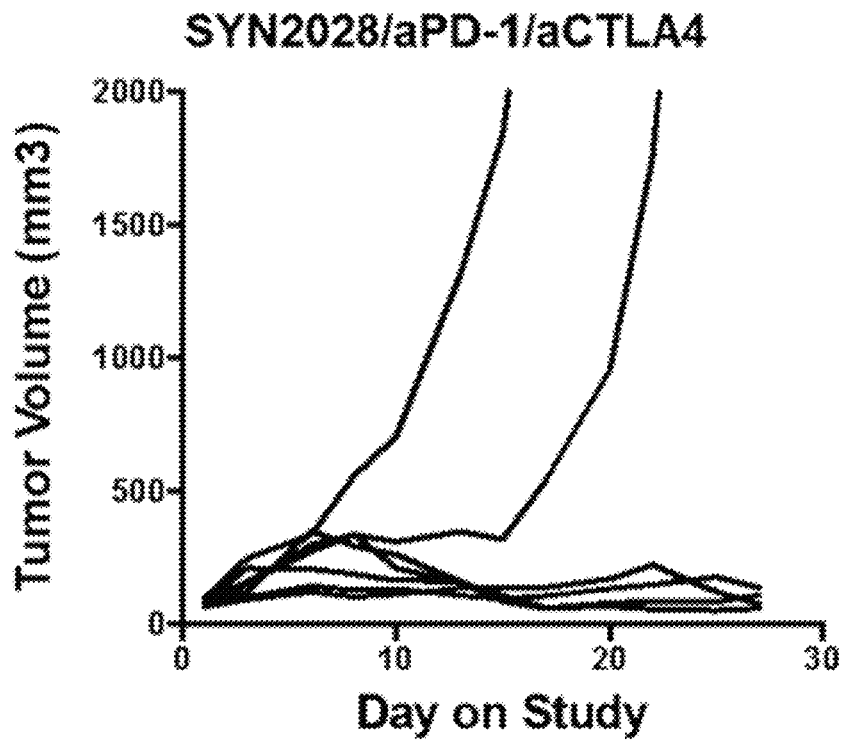
Figure 39F:
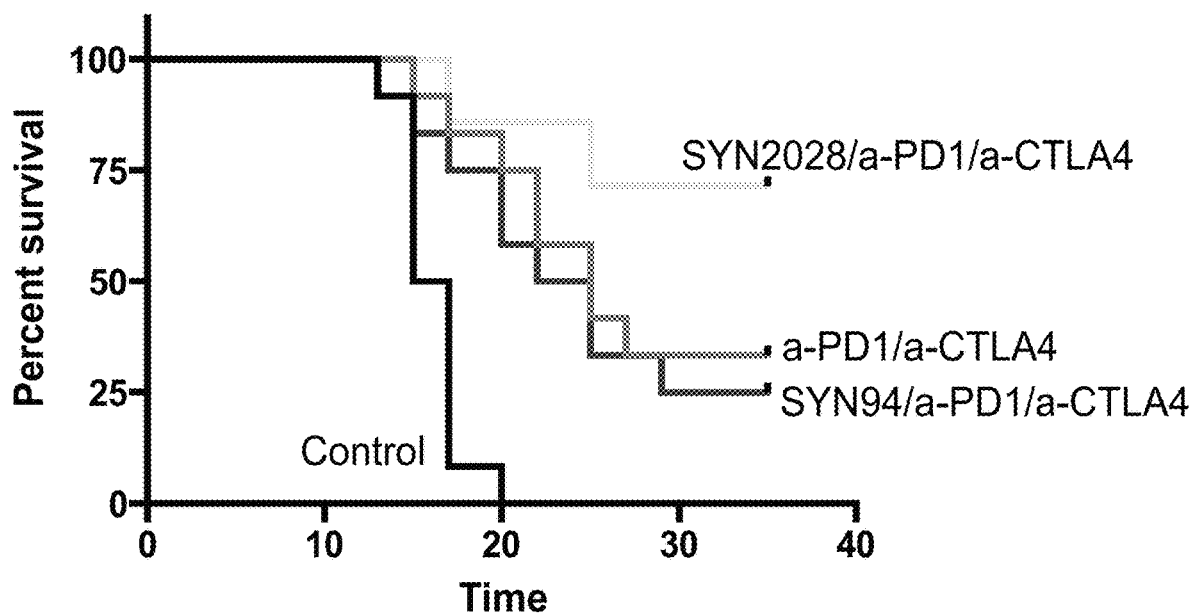
FIG. 39F depicts the corresponding Kaplan-Meier plot.

In some embodiments, the circuitry expressed by the genetically engineered bacteria is selected to combine multiple mechanisms. For example, by activating multiple orthogonal immunomodulatory pathways in the tumor microenvironment, immunologically cold tumors are transformed into immunologically hot tumors. Multiple effectors can be selected which have an impact on different components of the immune response. Different immune response components which can be targeted by the effectors expressed by the genetically engineered bacteria include immune activation and priming ("immune initiator"), and immune augmentation and T cell expansion, ("immune sustainer") (see FIG. 36). In some combination embodiments, an "immune initiator" is combined with an "immune sustainer". In some embodiments, an immune initiator and/or an immune sustainer may further be combined with a stromal modulator, e.g., hyaluronidase. In some embodiments, two or more different bacteria comprising genes encoding an immune initiator and an immune sustainer, and optionally a stromal modulator may be combined and administered concurrently or sequentially. Non-limiting examples of effectors for targeting immune activation and priming (immune initiator) described herein include soluble SIRPalpha, anti-CD47 antibodies, and anti-CD40 antibodies, CD4O-Ligand, TNF-alpha, IFN-gamma, 5-FC to 5-FU conversion, and STING agonists. Immune sustainers include agents that promote immune augmentation and agents that promote T cell expansion or both. Non-limiting examples of effectors for targeting immune augmentation described herein include kynurenine degradation, adenosine degradation, arginine production, CXCL10, IL-15, IL-12 secretion, and checkpoint blockade, e.g., through anti-PD-1 secretion or display. Non-limiting examples of effectors for targeting T cell expansion described herein include anti-PD-1 and anti-PD-L1 antibodies, anti-CTLA-4 antibodies, and IL-15. One example of an effector for targeting stromal modulation is hyaluronidase. In some embodiments, the selected effectors target immune activation and priming and T cell expansion. In some embodiments, the selected effectors target immune activation and priming and stromal modulation. In some embodiments, the selected effectors target immune augmentation and T cell expansion. In some embodiments, the selected effectors target immune augmentation and stromal modulation. In some embodiments, the selected effectors target T cell expansion and stromal modulation. In some embodiments, the selected effectors target immune activation and priming, immune augmentation, and T cell expansion. In some embodiments, the selected effectors target immune activation and priming, immune augmentation and stromal modulation. In some embodiments, the selected effectors target immune activation and priming, T cell expansion, and stromal modulation. In some embodiments, the selected effectors target immune augmentation, T cell expansion, and stromal modulation. In some embodiments, the selected effectors target immune activation and priming, immune augmentation, T cell expansion, and stromal modulation.

In some embodiments, genetically engineered bacteria comprise one or more gene sequence(s) encoding kynureninase (and optionally circuitry for the production of tryptophan described herein) and one or more gene sequences encoding IL-15 for secretion. In some embodiments kynureninase is from *Pseudomonas fluorescens*. In some embodiments, the genetically engineered bacteria comprise one or more gene sequence(s) encoding kynureninase (and optionally circuitry for the production of tryptophan described herein) and one or more gene sequences encoding CXCL10 for secretion. In some embodiments, the genetically engineered bacteria comprise one or more gene sequence(s) encoding CXCL10 and one or more gene sequences encoding IL-15. In some embodiments, the genetically engineered bacteria comprise one or more gene sequence(s) encoding kynureninase (and optionally circuitry for the production of tryptophan described herein), one or more gene sequences encoding IL-15, and one or more gene sequences encoding CXCL10. In any of these embodiments, the genetically engineered bacteria can further comprise one or more anti-PD-1 or anti-PD-L1 antibodies, e.g., scFvs. In one specific embodiment, the genetically engineered bacteria comprise one or more gene sequence(s) encoding kynureninase (and optionally circuitry for the production of tryptophan described herein), one or more gene sequences encoding IL-15, one or more gene sequences encoding CXCL10, and one or more gene sequences encoding an anti-PD-1 antibody.

In one specific embodiment, the genetically engineered bacteria comprise one or more gene sequence(s) encoding kynureninase (and optionally circuitry for the production of tryptophan described herein), one or more gene sequences encoding IL-15, one or more gene sequences encoding CXCL10, and one or more gene sequences encoding an anti-PD-L1 antibody. In any of these embodiments, the genetically engineered bacteria may be used for the treatment, management, and prevention of colorectal carcinoma. In any of these embodiments, the genetically engineered bacteria may be used for the treatment, management, and prevention of hepatocellular carcinoma. In any of these embodiments, the genetically engineered bacteria may be used for the treatment, management, and prevention of advanced melanoma. In any of these embodiments, the genetically engineered bacteria are administered orally. In any of these embodiments, the genetically engineered bacteria are administered intratumorally via intratumoral injection. In any of these embodiments, the genetically engineered bacteria are administered systemically. In any of these embodiments, optional tryptophan circuitry can include deletion of TrpE. In some embodiments, tryptophan production circuitry may comprise one or more of trpE, trpD, trpC, trpB, trpA, aroG, aroF, aroH, aroB, aroD, aroE, aroK, and aroC or a combination thereof. In some embodiments, such tryptophan production circuitry comprises one or more of aroG(fbr), trpE(fbr), trpD, trpC, trpB, trpA and combinations thereof. In some embodiments, tryptophan production circuitry comprises one or more of aroG(fbr), serA(fbr), trpE(fbr), trpD, trpC, trpB, trpA or combinations thereof. In some embodiments, such tryptophan production circuitry comprises aroG(fbr), serA(fbr), trpE(fbr), trpD, trpC, trpB, trpA, YddG or combinations thereof. In some embodiments, tryptophan production circuitry comprises trpE, trpD, trpC, trpB, trpA and combinations thereof.

In some embodiments, the bacteria comprise one or more genes encoding enzymes for the conversion of adenosine to urate and further comprise one or more gene sequences encoding anti-CD40 antibodies for secretion(e.g., scFv antibodies). Exemplary anti-CD40 antibodies from which an scFv can be derived are described herein. In some embodiments, the genetically engineered bacteria comprise gene sequence(s) encoding one or more copies of add, xapA, deoD, xdhA, xdhB, and xdhC and nupC, and further comprise gene sequences encoding anti-CD40 antibodies for secretion. In some embodiments, the genetically engineered bacteria comprise gene sequence(s) encoding one or more copies of add, xapA, deoD, xdhA, xdhB, and xdhC and nupG, and further comprise gene sequences encoding anti-CD40 antibodies for secretion. Suitable secretion tags and other sequences for the secretion of such antibodies are described herein.

In some embodiments, the bacteria comprise one or more genes encoding enzymes for the conversion of adenosine to urate and further comprise one or more gene sequences encoding anti-CD40 antibodies for surface display (e.g., scFv antibodies). In some embodiments, the genetically engineered bacteria comprise gene sequence(s) encoding one or more copies of add, xapA, deoD, xdhA, xdhB, and xdhC and nupC, and further comprise gene sequences encoding anti-CD40 antibodies for surface display. In some embodiments, the genetically engineered bacteria comprise gene sequence(s) encoding one or more copies of add, xapA, deoD, xdhA, xdhB, and xdhC and nupG genes, and further comprise gene sequences encoding anti-CD40 antibodies for surface display. Suitable membrane display anchors and other sequences for the surface display of such antibodies are described herein.

In some embodiments, the bacteria comprise one or more genes encoding hyaluronidase for secretion and further comprise one or more gene sequences encoding anti-CD40 antibodies for secretion(e.g., scFv antibodies). In some embodiments, the genetically engineered bacteria comprise gene sequence(s) encoding hyaluronidase, and further comprise gene sequences encoding anti-CD40 antibodies for secretion.

In some embodiments, the bacteria comprise one or more genes encoding hyaluronidase and further comprise one or more gene sequences encoding anti-CD40 antibodies for surface display (e.g., scFv antibodies). In some embodiments, the genetically engineered bacteria comprise gene sequence(s) encoding hyaluronidase, and further comprise gene sequences encoding anti-CD40 antibodies for surface display.

In some embodiments, the bacteria comprise one or more genes encoding enzymes for the conversion of adenosine to urate and further comprise one or more gene sequences encoding hyaluronidase for secretion. In some embodiments, the genetically engineered bacteria comprise gene sequence(s) encoding one or more copies of add, xapA, deoD, xdhA, xdhB, and xdhC and nupC, and further comprise gene sequences encoding hyaluronidase for secretion. In some embodiments, the genetically engineered bacteria comprise gene sequence(s) encoding one or more copies of add, xapA, deoD, xdhA, xdhB, and xdhC and nupG genes, and further comprise gene sequences encoding hyaluronidase.

In some embodiments, the bacteria comprise one or more genes encoding enzymes for the conversion of adenosine to urate, one or more gene sequences encoding anti-CD40 antibodies for secretion (e.g., scFv antibodies), and one or more gene sequences encoding hyaluronidase. In some embodiments, the genetically engineered bacteria comprise gene sequence(s) encoding one or more copies of add, xapA, deoD, xdhA, xdhB, and xdhC and nupC, one or more gene sequences encoding anti-CD40 antibodies for secretion, and one or more gene sequences encoding hyaluronidase. In some embodiments, the genetically engineered bacteria comprise gene sequence(s) encoding one or more copies of add, xapA, deoD, xdhA, xdhB, and xdhC and nupG genes, one or more gene sequences encoding anti-CD40 antibodies for secretion, and one or more gene sequences encoding hyaluronidase.

In some embodiments, the bacteria comprise one or more genes encoding enzymes for the conversion of adenosine to urate, one or more gene sequences encoding anti-CD40 antibodies for surface display (e.g., scFv antibodies), and one or more gene sequences encoding hyaluronidase. In some embodiments, the genetically engineered bacteria comprise gene sequence(s) encoding one or more copies of add, xapA, deoD, xdhA, xdhB, and xdhC and nupC, one or more gene sequences encoding anti-CD40 antibodies for surface display, and one or more gene sequences encoding hyaluronidase. In some embodiments, the genetically engineered bacteria comprise gene sequence(s) encoding one or more copies of add, xapA, deoD, xdhA, xdhB, and xdhC and nupG genes, one or more gene sequences encoding anti-CD40 antibodies for surface display, and one or more gene sequences encoding hyaluronidase. In any of these embodiments, the bacteria may be useful for the treatment, management and prevention of pancreatic ductal adenocarcinoma. In any of these embodiments, the genetically engineered bacteria are administered orally, intratumorally or systemically.

In some embodiments, the bacteria comprises gene sequence(s) encoding circuitry for the increased production of arginine and gene sequence(s) encoding one or more anti-CD47 antibodies. In some embodiments, the genetically engineered bacteria comprising gene sequence(s) encoding circuitry for the increased production of arginine further comprise gene sequences for the secretion of one or more anti-CD47 antibodies. In some embodiments, the genetically engineered bacteria comprising gene sequence(s) encoding circuitry for the increased production of arginine further comprise gene sequences for the surface display of one or more anti-CD47 antibodies. In some embodiments, the genetically engineered bacteria comprise one or more gene sequence for the secretion and/or surface display or one or more anti-CD47 antibodies and further comprise one or more arginine biosynthesis genes selected from argA, argB, argC, argD, argE, argF, argG, argH, argI, argJ, carA, and carB. In some embodiments for producing arginine and anti-CD47, an arginine repressor (argR) is deleted, mutated, or modified so as to diminish or obliterate its repressor function. In some embodiments for the production on anti-CD47 and arginine biosynthesis, the bacterium further comprises a gene encoding feedback resistant argA.

In some embodiments, the bacteria comprises gene sequence(s) encoding circuitry for the increased production of arginine and gene sequence(s) encoding one or more soluble forms of SIRPalpha, e.g., lacking the transmembrane and cytoplasmic portion. In some embodiments, the genetically engineered bacteria comprising gene sequence(s) encoding circuitry for the increased production of arginine further comprise gene sequences for the secretion of one or more soluble forms of SIRPalpha. In some embodiments, the genetically engineered bacteria comprise one or more gene sequences encoding one or more soluble forms of SIRPalpha and further comprise one or more arginine biosynthesis genes selected from argA, argB, argC, argD, argE, argF, argG, argH, argI, argJ, carA, and carB. In some embodiments, the genetically engineered bacteria comprising circuitry for producing arginine and one or more gene sequences for the secretion of one or more soluble forms of SIRPalpha, an arginine repressor (argR) is deleted, mutated, or modified so as to diminish or obliterate its repressor function. In some embodiments, the genetically engineered bacteria comprise one or more genes for the secretion of one or more soluble forms of SIRPalpha and further comprise circuitry for the production of arginine, including a gene encoding feedback resistant argA.

In some embodiments, the two or more gene sequence(s) for producing the anti-cancer molecule combinations are operably linked to one or more directly or indirectly inducible promoter(s). In some embodiments, the two or more gene sequence(s) are operably linked to a directly or indirectly inducible promoter that is induced under exogeneous environmental conditions, e.g., conditions found in the gut, the tumor microenvironment or other tissue specific conditions. In some embodiments, the two or more gene sequence(s) are operably linked to a directly or indirectly inducible promoter that is induced by metabolites found in the gut, the tumor microenvironment or other specific conditions. In some embodiments, the two or more gene sequence(s) are operably linked to a directly or indirectly inducible promoter that is induced under low-oxygen or anaerobic conditions. In some embodiments, the two or more gene sequence(s) are operably linked to a directly or indirectly inducible promoter that is induced under inflammatory conditions (e.g., RNS, ROS), as described herein. In some embodiments, the two or more gene sequence(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In any of the above combination embodiments, the gene sequence(s) for producing the one or more anti-cancer molecules and operatively linked promoter are present on a chromosome in the bacterium. In any of the above combination embodiments, the gene sequence(s) for producing the one or more anti-cancer molecules and operatively linked promoter are present on a plasmid in the bacterium. In any of the above combination embodiments, the bacterium is an auxotroph comprising a deletion or mutation in a gene required for cell survival and/or growth, e.g., wherein the gene is selected from thyA, dapD, and dapA. In any of the above combination embodiment, the genetically engineered bacterium comprises a kill switch.

In any of the embodiments described in this section in which the genetically engineered bacteria are capable of producing one or more immune modulators that activate, stimulate, and/or induce the differentiation of T effector cells, e.g., CD4+ and CD8+ cells and/or are capable of producing one or more immune modulators that inhibit immune suppressors molecules, e.g., immune checkpoints and Tregs, the genetically engineered bacteria may further be capable of producing a lytic peptide molecule. In some embodiments, the genetically engineered bacteria comprise sequence encoding one or more lytic peptide molecules, selected from D-peptide A, D-peptide B, D-peptide C, D-peptide D, DK6L9, NRC-03, NRC-07, Gomesin, Hepcidin TH2-3, Dermaseptin B2, PTP7, MGA2, HNP-1, Tachyplesin, Temporin-10Ea, NK-2, Bovine lactoferrin B6, Cecropin CB1, Polybia-MPI, SVS-1, Epinecidin-1, D-K6L9, MPI-1, A9K, Hectate, Phor14, Phor21, BEPTII, BEPTII-I, TfR-lytic peptide, BPC96, RGD-Tachyplesin, A9K, ERa17p, CR1166, peptide aptamers, Pentastatin-1, chemokinostatin-1, properdistatin, Myristoyl-Cys-Ala-Val-Ala-Tyr-(1,3 dimethyl)His-OMe ("Cys-Ala-Val-Ala-Tyr-(1,3 dimethyl)His" disclosed as SEQ ID NO: 1248), 9 somatostatin peptide analogues, and LTX-401.

In some embodiments, the genetically engineered microorganisms encode one or more cassettes which produce GM_CSF, CpG-rich oligo-nucleotide, and tumor cell lysates or antigens derived therefrom, as described in Ali et al. *Sci Transl Med* 1, 8ra19 (2009) In Situ Regulation of DC Subsets and T Cells Mediates Tumor Regression in Mice, the contents of which is herein incorporated by reference in its entirety.

In any of the embodiments described in this section in which the genetically engineered bacteria are capable of producing one or more immune modulators that activate, stimulate, and/or induce the differentiation of T effector cells, e.g., CD4+ and CD8+ cells and/or are capable of producing one or more immune modulators that inhibit immune suppressors molecules, e.g., immune checkpoints and Tregs, the genetically engineered bacteria may further be capable of producing one or more tumor antigens, such as any of the tumor antigens described herein or otherwise known in the art.

In some embodiments, the genetically engineered bacteria of the invention produce the anti-cancer molecule under low-oxygen conditions and are capable of reducing cell proliferation, tumor growth, and/or tumor volume by at least about 10%, 20%, 25%, 30%, 40%, 50%, 60%, 70%, 75%, 80%, 85%, 90%, 95%, or more as compared to an unmodified bacteria of the same subtype under the same conditions.

In some embodiments, the genetically engineered bacteria express the gene for producing the anti-cancer molecule on a plasmid and/or a chromosome. The gene or gene cassettes for producing the anti-cancer molecule may be integrated into the bacterial chromosome at one or more integration sites. For example, one or more copies of the sequence encoding the anti-cancer molecule may be integrated into the bacterial chromosome. Having multiple copies of the gene encoding the anti-cancer molecule integrated into the chromosome allows for greater production of the molecule and also permits fine-tuning of the level of expression. Alternatively, different circuits described herein, such as any of the kill switch circuits, in addition to the gene encoding the anti-cancer molecule could be integrated into the bacterial chromosome at one or more different integration sites to perform multiple different functions. Multiple distinct anti-cancer molecules may be produced by the genetically engineered bacteria.

In any of these embodiments and all combination embodiments, a engineered bacteria can be used in conjunction with conventional cancer therapies, such as surgery, chemotherapy, targeted therapies, radiation therapy, tomotherapy, immunotherapy, cancer vaccines, hormone therapy, hyperthermia, stem cell transplant (peripheral blood, bone marrow, and cord blood transplants), photodynamic therapy, oncolytic virus therapy, and blood product donation and transfusion. In any of these embodiments for producing an anti-cancer molecule, e.g., an immune inhibitor (antibody), agonistic antibody, agonist antibody, and/or immunostimulatory cytokine, a combination of engineered bacteria can be used in conjunction with other conventional immunotherapies used to treat cancer, such as checkpoint inhibitors, Fc-mediated ADCC, BiTE, TCR, adoptive cell therapy (TILs, CARs, NK/NKT, etc.), and any of the other immunotherapies described herein and otherwise known in the art. In any of these embodiments, the engineered bacteria can produce one or more cytotoxins or lytic peptides. In any of these embodiments, the engineered bacteria can be used in conjunction with a cancer or tumor vaccine.

In any of these combination embodiments, the genetically engineered bacteria may comprise gene sequence(s) encoding one or more fusion proteins. In some embodiments, the genetically engineered bacteria comprise gene sequence(s) encoding an effector or anti-cancer molecule fused to a stabilizing polypeptide. Such stabilizing polypeptides are known in the art and include Fc proteins. In some embodiments, the fusion proteins encoded by the genetically engineered bacteria are Fc fusion proteins, such as IgG Fc fusion proteins or IgA Fc fusion proteins.

In any of these combination embodiments, the anti-cancer molecule may be covalently fused to the stabilizing polypeptide through a peptide linker or a peptide bond. In some embodiments, the anti-cancer molecule is covalently fused to the stabilizing polypeptide through a peptide linker or a peptide bond. In some embodiments, the C terminus of the anti-cancer molecule is covalently fused to the N terminus of the stabilizing polypeptide through the peptide linker or peptide bond. In some embodiments, the N terminus of the anti-cancer molecule is covalently fused to the C terminus of the stabilizing polypeptide through the peptide linker or peptide bond. In some embodiments, the stabilizing polypeptide comprises an immunoglobulin Fc polypeptide. In some embodiments, the immunoglobulin Fc polypeptide comprises at least a portion of an immunoglobulin heavy chain CH2 constant region. In some embodiments, the immunoglobulin Fc polypeptide comprises at least a portion of an immunoglobulin heavy chain CH3 constant region. In some embodiments, the immunoglobulin Fc polypeptide comprises at least a portion of an immunoglobulin heavy chain CH1 constant region. In some embodiments, the immunoglobulin Fc polypeptide comprises at least a portion of an immunoglobulin variable hinge region. In some embodiments, the immunoglobulin Fc polypeptide comprises at least a portion of an immunoglobulin variable hinge region, immunoglobulin heavy chain CH2 constant region and an immunoglobulin heavy chain CH3 constant region. In some embodiments, the immunoglobulin Fc polypeptide is a human IgG Fc polypeptide. In some embodiments, the immunoglobulin Fc polypeptide is a human IgG4 Fc polypeptide. In some embodiments, the linker comprises a glycine rich peptide. In some embodiments, the glycine rich peptide comprises the sequence [GlyGlyGlyGlySer]n where n is 1, 2, 3, 4, 5 or 6 (SEQ ID NO: 1242). In some embodiments, the fusion protein comprises a SIRPalpha IgG FC fusion polypeptide. In some embodiments, the fusion protein comprises a SIRPalpha IgG4 Fc polypeptide. In some embodiments, the glycine rich peptide linker comprises the sequence SGGGGSGGGGSGGGGS (SEQ ID NO: 1243). In some embodiments, the N terminus of SIRPalpha is covalently fused to the C terminus of a IgG4 Fc through the peptide linker comprising SGGGGSGG-GGSGGGGS (SEQ ID NO: 1243).

In any of these combination embodiments, the genetically engineered bacteria comprise one or more gene sequences encoding components of a multimeric polypeptide. In some embodiments, the polypeptide is a dimer. Non-limiting example of a dimeric proteins include cytokines, such as IL-15 (heterodimer). In some embodiments, genetically engineered bacteria comprise one or more gene(s) encoding one or more polypeptides wherein the one or more polypeptides comprise a first monomer and a second monomer. In some embodiments, the first monomer polypeptide is covalently linked to a second monomer polypeptide through a peptide linker or a peptide bond. In some embodiments, the linker comprises a glycine rich peptide. In some embodiments, the first and the second monomer have the same polypeptide sequence. In some embodiments, the first and the second monomer have each have a different polypeptide sequence. In some embodiments, the first monomer is a IL-12 p35 polypeptide and the second monomer is a IL-12 p40 polypeptide. In some embodiments, the linker comprises GGGGSGGGS (SEQ ID NO: 1244).

In any of these combination embodiments, effector function of an anti-cancer molecule can be improved through fusion to another polypeptide that facilitates effector function. A non-limiting example of such a fusion is the fusion of IL-15 to the Sushi domain of IL-15Ralpha, as described herein. In some embodiments, accordingly, a first monomer polypeptide is a IL-15 monomer and the second monomer is a IL-15R alpha sushi domain polypeptide.

In any of these embodiments and all combination embodiments, the genetically engineered bacteria comprise gene sequence(s) encoding one or more secretion tags described herein. In any of these embodiments, the genetically engineered bacteria comprise one or more mutations in an endogenous membrane associated protein allowing for the diffusible outer membrane phenotype. Suitable outer membrane mutations are described herein.

Combinations of Immune Activators and Immune Sustainers

In some embodiments, the genetically engineered bacteria comprise circuitry that can target immune activation and priming (initiators) and immune sustainers (e.g., immune augmentation or T cell expansion). Alternatively, the disclosure provides a composition comprising a combination (e.g., two or more) of different genetically engineered bacteria, each bacteria encoding one or more immune activators/primers (initiators) and/or one or more immune sustainers. Such distinct or different bacterial strains can be administered concurrently or sequentially. Non-limiting examples of immune initiators and sustainers are described in Table A and Table B.

TABLE A

| Immune Initiators | | |
|---|---|---|
| Effect | Type | Effector |
| Immune activation/Priming | Cytokine/Chemokine | TNF-alpha |
| Immune activation/Priming | Cytokine/Chemokine | IFN-gamma |
| Immune activation/Priming | Cytokine/Chemokine | IFN-beta1 |
| Immune activation/Priming | Single chain antibodies/Ligands | SIRPalpha |
| Immune activation/Priming | Single chain antibodies/Ligands | CD40L |
| Immune activation/Priming | Metabolic conversion | STING agonist |
| Oncolysis/Priming | Engineered chemotherapy | 5FC−>5FU |

TABLE B

Immune Sustainers

| Effect | Type | Effector |
| --- | --- | --- |
| Immune Augmentation/Reversal of Exhaustion | Single chain antibodies/Ligands | Anti-PD-1 |
| Immune Augmentation/T cell Expansion | Single chain antibodies/Ligands | Anti-CTLA4 |
| Immune Augmentation/T cell Expansion | Cytokine/Chemokine | IL-15 |
| Immune Augmentation/T cell Expansion | Cytokine/Chemokine | CXCL10 |
| Immune Augmentation/T cell Expansion | Metabolic conversion | Arginine producer |
| Immune Augmentation/T cell Expansion | Metabolic conversion | Adenosine consumer |
| Immune Augmentation/T cell Expansion | Metabolic conversion | Kynurenine consumer |

In some combination embodiments, one or more effectors of Table A can be combined with one or more effectors of Table B.

Multiple effectors can be selected which have an impact on different components of the immune response. Different immune response components which can be targeted by the effectors expressed by one or more genetically engineered bacteria include immune activation and priming ("immune initiator"), immune augmentation, T cell expansion, ("immune sustainer") (see FIG. 36). In some combination embodiments, an "immune initiator" is combined with an "immune sustainer". In some embodiments, an immune initiator and/or an immune sustainer may further be combined with a stromal modulator, e.g., hyaluronidase. In some embodiments, two or more different bacteria comprising genes encoding an immune initiator and an immune sustainer, and optionally a stromal modulator may be combined and administered concurrently or sequentially. Non-limiting examples of effectors for targeting immune activation and priming described herein include soluble SIRPalpha, anti-CD47 antibodies, and anti-CD40 antibodies, CD4O-Ligand, TNF-alpha, IFN-gamma, 5-FC to 5-FU conversion, and STING agonists. Non-limiting examples of effectors for targeting immune augmentation described herein include kynurenine degradation, adenosine degradation, arginine production, CXCL10, IL-15, IL-12 secretion, and checkpoint blockade, e.g., through anti-PD-1 secretion or display. Non-limiting examples of effectors for targeting T cell expansion described herein include anti-PD-1 and anti-PD-L1 antibodies, anti-CTLA-4 antibodies, and IL-15.

In one combination embodiment, genetically engineered bacteria comprise gene sequences for the production of one or more immune initiators combined with one or more gene sequences for the production of one or more immune sustainers. In alternate embodiments, the disclosure provides a composition comprising a combination (e.g., two or more) of different genetically engineered bacteria. In one such composition embodiment, one or more genetically engineered bacteria comprising gene sequences for the production of one or more immune initiators may be combined with one or more genetically engineered bacteria comprising gene sequences for the production of one or more immune sustainers. Alternatively, each bacteria in the composition may have both immune sustainer(s) and immune initiator(s).

In any of these combination and/or composition embodiments, one immune initiator may be a chemokine or cytokine. In some immune sustainer and immune initiator combination and/or composition embodiments, one immune initiator is a chemokine or cytokine and one immune sustainer is a single chain antibody. In some embodiments, one immune initiator is a chemokine or cytokine and one immune sustainer is a receptor ligand. In some embodiments, one immune initiator is a chemokine or cytokine and one immune sustainer is a receptor ligand. In some embodiments, one immune initiator is a chemokine or cytokine and one immune sustainer is a receptor ligand. In some embodiments, one immune initiator is a chemokine or cytokine and one immune sustainer is a chemokine or cytokine. In some embodiments, one immune initiator is a chemokine or cytokine and one immune sustainer is a metabolic conversion. The metabolic conversion may be an arginine production, adenosine consumption, and/or kynurenine consumption. In some embodiments, the chemokine or cytokine initiator is selected from TNF-alpha, IFN-gamma and IFN-beta1. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption.

In any of these combination and/or composition embodiments, one immune initiator may be a single chain antibody. In some immune sustainer and immune initiator combination and/or composition embodiments, one immune initiator is a single chain antibody and one immune sustainer is a single chain antibody. In some embodiments, one immune initiator is a single chain antibody and one immune sustainer is a receptor ligand. In some embodiments, one immune initiator is a single chain antibody and one immune sustainer is a receptor ligand. In some embodiments, one immune initiator is a single chain antibody and one immune sustainer is a receptor ligand. In some embodiments, one immune initiator is a single chain antibody and one immune sustainer is a chemokine or cytokine. In some embodiments, one immune initiator is a single chain antibody and one immune sustainer is a metabolic conversion. The metabolic conversion may be an arginine production, adenosine consumption, and/or kynurenine consumption. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption.

In any of these combination and/or composition embodiments, one immune initiator may be a receptor ligand. In some immune sustainer and immune initiator combination and/or composition embodiments, one immune initiator is a receptor ligand and one immune sustainer is a single chain antibody. In some embodiments, one immune initiator is a receptor ligand and one immune sustainer is a receptor ligand. In some embodiments, one immune initiator is a receptor ligand and one immune sustainer is a receptor ligand. In some embodiments, one immune initiator is a receptor ligand and one immune sustainer is a chemokine or cytokine. In some embodiments, one immune initiator is a receptor ligand and one immune sustainer is a metabolic conversion. The metabolic conversion may be an arginine production, adenosine consumption, and/or kynurenine consumption. In some embodiments, in which one immune initiator is a receptor ligand, the immune initiator is CD40L. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption. In some embodiments, the receptor ligand is SIRPalpha, or a fragment, variant or fusion protein thereof. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption.

In any of these combination and/or composition embodiments, one immune initiator may be a metabolic conversion. In some immune sustainer and immune initiator combination and/or composition embodiments, one immune initiator is a metabolic conversion and one immune sustainer is a single chain antibody. In some embodiments, one immune initiator is a metabolic conversion and one immune sustainer is a receptor ligand. In some embodiments, one immune initiator is a metabolic conversion and one immune sustainer is a receptor ligand. In some embodiments, one immune initiator is a metabolic conversion and one immune sustainer is a chemokine or cytokine. In some embodiments, one immune initiator is a metabolic conversion and one immune sustainer is a metabolic conversion, e.g., selected from kynurenine consumer, tryptophan producer, arginine producer, and adenosine consumer. In some embodiments, the initiator metabolic conversion is a STING agonist producer, e.g., deadenylate cyclase, e.g., DacA. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption.

In any of these combination and/or composition embodiments, one immune initiator may be an engineered immunotherapy. In some immune sustainer and immune initiator combination and/or composition embodiments, one immune initiator is an engineered chemotherapy and one immune sustainer is a single chain antibody. In some embodiments, one immune initiator is an engineered chemotherapy and one immune sustainer is a receptor ligand. In some embodiments, one immune initiator is an engineered chemotherapy and one immune sustainer is a receptor ligand. In some embodiments, one immune initiator is an engineered chemotherapy and one immune sustainer is a chemokine or cytokine. In some embodiments, one immune initiator is an engineered chemotherapy and one immune sustainer is a metabolic conversion. The metabolic conversion may be an arginine production, adenosine consumption, and/or kynurenine consumption. In some embodiments, the initiator engineered chemotherapy is a 5FC to 5FU conversion, e.g., though codA, or variants or fusion proteins thereof. In any of these embodiments, the immune sustainer or augmenter may be selected from Anti-PD-1 single chain antibody, Anti-CTLA4 single chain antibody, IL-15, CXCL10 or a metabolic conversion. The metabolic conversion may be an arginine production, adenosine consumption, and/or kynurenine consumption.

In any of these combination and/or composition embodiments, one immune sustainer may be a single chain antibody. In some immune sustainer and immune initiator combination and/or composition embodiments, one immune sustainer is a single chain antibody and the immune initiator is a cytokine or chemokine. In some embodiments, one immune sustainer is a single chain antibody and the immune initiator is a receptor ligand. In some embodiments, one immune sustainer is a single chain antibody and the immune initiator is a single chain antibody. In some embodiments, one immune sustainer is a single chain antibody and the immune initiator is a metabolic conversion. In some embodiments, one immune sustainer is a single chain antibody and the immune initiator is an engineered chemotherapy. In some immune sustainer and immune initiator combination and/or composition embodiments, the immune sustainer is an anti-PD-1 antibody. In some immune sustainer and immune initiator combination and/or composition embodiments, the immune sustainer is an anti-CTLA4 antibody. In any of these embodiments, the immune initiator may be selected from TNF-alpha, IFN-gamma, IFN-beta1, SIRPalpha, CD40L, STING agonist, and 5FC->5FU.

In any of these combination and/or composition embodiments, one immune sustainer may be a receptor ligand. In some immune sustainer and immune initiator combination and/or composition embodiments, one immune sustainer is a receptor ligand and the immune initiator is a cytokine or chemokine. In some embodiments, one immune sustainer is a receptor ligand and the immune initiator is a receptor ligand. In some embodiments, one immune sustainer is a receptor ligand and the immune initiator is a single chain antibody. In some embodiments, one immune sustainer is a receptor ligand and the immune initiator is a metabolic conversion. In some embodiments, one immune sustainer is a receptor ligand and the immune initiator is an engineered chemotherapy. In some immune sustainer and immune initiator combination and/or composition embodiments, the immune sustainer is PD1 or PDL1 or CTLA4, or a fragment, variant or fusion protein thereof. In any of these embodiments, the immune initiator may be selected from TNF-alpha, IFN-gamma, IFN-beta1, SIRPalpha, CD40L, STING agonist, and 5FC->5FU.

In any of these combination and/or composition embodiments, one immune sustainer may be a cytokine or chemokine. In some immune sustainer and immune initiator combination and/or composition embodiments, one immune sustainer is a cytokine or chemokine and the immune initiator is a cytokine or chemokine. In some embodiments, one immune sustainer is a cytokine or chemokine and the immune initiator is a receptor ligand. In some embodiments, one immune sustainer is a cytokine or chemokine and the immune initiator is a single chain antibody. In some embodiments, one immune sustainer is a cytokine or chemokine and the immune initiator is a metabolic conversion. In some embodiments, one immune sustainer is a cytokine or chemokine and the immune initiator is an engineered chemotherapy. In some immune sustainer and immune initiator combination and/or composition embodiments, the immune sustainer is IL-15, or a fragment, variant or fusion protein thereof. In some immune sustainer and immune initiator combination and/or composition embodiments, the immune sustainer is CXCL10, or a fragment, variant or fusion protein thereof. In any of these embodiments, the immune initiator may be selected from TNF-alpha, IFN-gamma, IFN-beta1, SIRPalpha, CD40L, STING agonist, and 5FC->5FU.

In any of these combination and/or composition embodiments, one immune sustainer may be a metabolic conversion. In some immune sustainer and immune initiator combination and/or composition embodiments, one immune sustainer is a metabolic conversion and the immune initiator is a cytokine or chemokine. In some embodiments, one immune sustainer is a metabolic conversion and the immune initiator is a receptor ligand. In some embodiments, one immune sustainer is a metabolic conversion and the immune initiator is a single chain antibody. In some embodiments, one immune sustainer is a metabolic conversion and the immune initiator is a metabolic conversion. In some embodiments, one immune sustainer is a metabolic conversion and the immune initiator is an engineered chemotherapy. In some immune sustainer and immune initiator combination and/or composition embodiments, the immune sustainer is kynurenine consumption. In some immune sustainer and immune initiator combination and/or composition embodiments, the immune sustainer is arginine production. In some immune sustainer and immune initiator combination and/or composition embodiments, the immune sustainer is adenosine consumption. In any of these embodiments, the immune initiator may be selected from TNF-alpha, IFN-gamma, IFN-beta1, SIRPalpha, CD40L, STING agonist, and 5FC->5FU.

In any of these combination embodiments, the genetically engineered bacteria may comprise gene sequences encoding enzymes for the consumption of kynurenine (and optionally production of tryptophan) and gene sequences for the production of an immune initiator. In some embodiments, the genetically engineered bacteria comprise gene sequences encoding kynureninase and gene sequences for the production of an immune initiator. In some embodiments, the immune initiator combined with kynureninase is a chemokine or a cytokine. In some embodiments, the immune initiator combined with kynureninase is a single chain antibody. In some embodiments, the immune initiator combined with kynureninase is a receptor ligand. In some embodiments, the immune initiator combined with kynureninase is metabolic conversion, e.g., a STING agonist producer, e.g., deadenylate cyclase, e.g., dacA. In some embodiments, the immune initiator combined with kynureninase is an engineered chemotherapy, e.g., codA for the conversion of 5FC to 5FU. In some embodiments, the immune initiator is selected from TNF-alpha, IFN-gamma, IFN-beta1, SIRPalpha, CD40L, STING agonist, and 5FC->5FU. In one embodiment, the genetically engineered bacteria comprise gene sequences encoding kynureninase and gene sequences encoding TNF-alpha. In one embodiment, the genetically engineered bacteria comprise gene sequences encoding kynureninase and gene sequences encoding IFN-gamma. In one embodiment, the genetically engineered bacteria comprise gene sequences encoding kynureninase and gene sequences encoding IFN-beta1. In one embodiment, the genetically engineered bacteria comprise gene sequences encoding kynureninase and gene sequences encoding SIRPalpha or a variant thereof described herein. In one embodiment, the genetically engineered bacteria comprise gene sequences encoding kynureninase and gene sequences encoding CD40L. In one embodiment, the genetically engineered bacteria comprise gene sequences encoding kynureninase and gene sequences encoding an enzyme for the production of a STING agonist, e.g., dacA, for the production of cyclic-di-AMP. In one embodiment, the genetically engineered bacteria comprise gene sequences encoding kynureninase and gene sequences encoding an enzyme for the conversion of 5FC to 5FU, e.g., codA or a variant or fusion protein thereof. In any of these kynurenine consumption and immune initiator combination and/or composition embodiments, trpE may be deleted.

In any of these combination embodiments, the genetically engineered bacteria may comprise gene sequences encoding enzymes for the production of a STING agonist and gene sequences for the production of an immune sustainer. In some embodiments, the genetically engineered bacteria comprise gene sequences encoding e.g., deadenylate cyclase, e.g., dacA, and gene sequences for the production of an immune sustainer. In some embodiments, the immune sustainer combined with dacA is a chemokine or a cytokine. In some embodiments, the immune sustainer combined with dacA is a single chain antibody. In some embodiments, the immune sustainer combined with deadenylate cyclase, e.g., dacA is a receptor ligand. In some embodiments, the immune sustainer combined with deadenylate cyclase, e.g., dacA is metabolic conversion, e.g., an arginine producer, kynurenine consumer and/or adenosine consumer. In some embodiments, the immune sustainer is selected from anti-PD-1 antibody, anti-CTLA4 antibody, IL-15, CXCL10, arginine producer, adenosine consumer, and kynurenine consumer. In one embodiment, the genetically engineered bacteria comprise gene sequences encoding dacA and gene sequences encoding an anti-PD-1 antibody. In one embodiment, the genetically engineered bacteria comprise gene sequences encoding deadenylate cyclase, e.g., dacA and gene sequences encoding anti-CTLA4 antibody. In one embodiment, the genetically engineered bacteria comprise gene sequences encoding dacA and gene sequences encoding IL-15. In one embodiment, the genetically engineered bacteria comprise gene sequences encoding deadenylate cyclase, e.g., dacA and gene sequences encoding CXCL10. In one embodiment, the genetically engineered bacteria comprise gene sequences encoding deadenylate cyclase, e.g., dacA and gene sequences encoding a circuitry for the production of arginine, e.g., as described herein. In one embodiment, the genetically engineered bacteria comprise gene sequences encoding deadenylate cyclase, e.g., dacA and gene sequences encoding an enzyme for the consumption of kynurenine, e.g., kynureninase, e.g., from *Pseudomonas fluorescens*. In one embodiment, the genetically engineered bacteria comprise gene sequences encoding deadenylate cyclase, e.g., dacA and gene sequences encoding an enzyme for the consumption adenosine, as described herein. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, dacA is from *Listeria monocytogenes*.

In any of these composition embodiments, one or more different genetically engineered bacteria comprising gene sequences encoding enzymes for the consumption of kynurenine (and optionally production of tryptophan) may be combined with one or more different genetically engineered bacteria comprising gene sequences for the production of an immune initiator. In some embodiments, the one or more different genetically engineered bacteria of the composition comprising gene sequences encoding kynureninase are combined with one or more different genetically engineered bacteria comprising gene sequences for the production of an immune initiator. In some embodiments, the immune initiator combined with kynureninase is a chemokine or a cytokine. In some embodiments, the immune initiator combined with kynureninase is a single chain antibody. In some embodiments, the immune initiator combined with kynureninase is a receptor ligand. In some embodiments, the immune initiator combined with kynureninase is metabolic conversion, e.g., a STING agonist producer, e.g., deadenylate cyclase, e.g., dacA. In some embodiments, the immune initiator combined with kynureninase is an engineered chemotherapy, e.g., codA for the conversion of 5FC to 5FU. In some embodiments, the immune initiator is selected from TNF-alpha, IFN-gamma, IFN-beta1, SIRPalpha, CD40L, STING agonist, and 5FC->5FU. In one embodiment, the one or more different genetically engineered bacteria comprise gene sequences encoding kynureninase and gene sequences encoding TNF-alpha. In one embodiment, the one or more different genetically engineered bacteria of the composition comprising gene sequences encoding kynureninase are combined with one or more different genetically engineered bacteria comprising gene sequences encoding IFN-gamma. In one embodiment, the one or more different genetically engineered bacteria of the composition comprising gene sequences encoding kynureninase are combined with one or more different genetically engineered bacteria comprising gene sequences encoding IFN-beta1. In one embodiment, the one or more different genetically engineered bacteria of the composition comprising gene sequences encoding kynureninase are combined with one or more different genetically engineered bacteria comprising gene sequences encoding SIRPalpha or a variant thereof described herein. In one embodiment, the one or more different genetically engineered bacteria of the composition comprising gene sequences encoding kynureninase are combined with one or more different genetically engineered bacteria comprising gene sequences encoding CD40L. In one embodiment, the one or more different genetically engineered bacteria of the composition comprising gene sequences encoding kynureninase are combined with one or more different genetically engineered bacteria comprising gene sequences encoding an enzyme for the production of a STING agonist, e.g., dacA for the production of cyclic-di-AMP. In one embodiment, the one or more different genetically engineered bacteria of the composition comprising gene sequences encoding kynureninase are combined with one or more different genetically engineered bacteria comprising gene sequences encoding an enzyme for the conversion of 5FC to 5FU, e.g., codA or a variant or fusion protein thereof. In any of these kynurenine consumption and immune initiator combination and/or composition embodiments, trpE may be deleted.

In any of these composition embodiments, the one or more different genetically engineered bacteria which may comprise gene sequences encoding enzymes for the production of a STING agonist may be combined with one or more different genetically engineered bacteria comprising gene sequences for the production of an immune sustainer. In some embodiments, the one or more different genetically engineered bacteria of the composition comprising gene sequences encoding deadenylate cyclase, e.g., dacA are combined with one or more different genetically engineered bacteria comprising gene sequences for the production of an immune sustainer. In some embodiments, the immune sustainer combined with deadenylate cyclase, e.g., dacA is a chemokine or a cytokine. In some embodiments, the immune sustainer combined with dacA is a single chain antibody. In some embodiments, the immune sustainer combined with deadenylate cyclase, e.g., dacA is a receptor ligand. In some embodiments, the immune sustainer combined with deadenylate cyclase, e.g., dacA is metabolic conversion, e.g., an arginine producer, kynurenine consumer and/or adenosine consumer. In some embodiments, the immune sustainer is selected from anti-PD-1 antibody, anti-CTLA4 antibody, IL-15, CXCL10, arginine producer, adenosine consumer, and kynurenine consumer. In one embodiment, the one or more different genetically engineered bacteria of the composition comprising gene sequences encoding deadenylate cyclase, e.g., dacA are combined with one or more different genetically engineered bacteria comprising gene sequences encoding an anti-PD-1 antibody. In one embodiment, the one or more different genetically engineered bacteria of the composition comprising gene sequences encoding deadenylate cyclase, e.g., dacA are combined with one or more different genetically engineered bacteria comprising gene sequences encoding anti-CTLA4 antibody. In one embodiment, the one or more different genetically engineered bacteria of the composition comprising gene sequences encoding deadenylate cyclase, e.g., dacA are combined with one or more different genetically engineered bacteria comprising gene sequences encoding IL-15. In one embodiment, the one or more different genetically engineered bacteria of the composition comprising gene sequences encoding deadenylate cyclase, e.g., dacA are combined with one or more different genetically engineered bacteria comprising gene sequences encoding CXCL10. In one embodiment, the one or more different genetically engineered bacteria of the composition comprising gene sequences encoding deadenylate cyclase, e.g., dacA are combined with one or more different genetically engineered bacteria comprising gene sequences encoding a circuitry for the production of arginine, e.g., as described herein. In one embodiment, the one or more different genetically engineered bacteria of the composition comprising gene sequences encoding deadenylate cyclase, e.g., dacA are combined with one or more different genetically engineered bacteria comprising gene sequences encoding an enzyme for the consumption of kynurenine, e.g., kynureninase, e.g., from *Pseudomonas fluorescens*. In one embodiment, the one or more different genetically engineered bacteria of the composition comprising gene sequences encoding dacA are combined with one or more different genetically engineered bacteria comprising gene sequences encoding an enzyme for the consumption adenosine, as described herein. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, dacA is from *Listeria monocytogenes*.

In one embodiment, the genetically engineered bacteria comprise one or more genes encoding enzymes for the production of STING agonist(s) in combination with one or more genes encoding enzymes for the consumption of kynurenine. In one embodiment, the STING agonist produced is c-di-AMP. In one embodiment, the genetically engineered bacteria comprises gene sequences encoding a diadenylate cyclase in combination with gene sequences encoding a kynureninase. In one embodiment, the diadenylate cyclase is from *Listeria monocytogenes*. In one embodiment, the kynureninase is from *Pseudomonas fluorescens*. In one specific embodiment, the diadenylate cyclase is from *Listeria monocytogenes* and the kynureninase is from *Pseudomonas fluorescens*. In one embodiment, the STING agonist produced is cyclic-di-GAMP. In one embodiment, the genetically engineered bacteria comprises gene sequences encoding a c-di-GAMP synthase in combination with gene sequences encoding a kynureninase. In one embodiment, the c-di-GAMP synthases is from *Vibrio cholerae*. In one embodiment, the kynureninase is from *Pseudomonas fluorescens*. In one specific embodiment, the c-di-GAMP synthase is from *Vibrio cholerae* and the kynureninase is from *Pseudomonas fluorescens*. In one specific embodiment, the kynureninase from *Pseudomonas fluorescens* is chromosomally integrated and under control of a constitutive promoter.

In alternate embodiments, the disclosure provides a composition comprising a combination (e.g., two or more) of different genetically engineered bacteria, each bacteria encoding a different immune modulator. In one embodiment, the composition comprises genetically engineered bacteria comprising one or more genes encoding enzymes for the production of STING agonist(s) and genetically engineered bacteria comprising one or more genes encoding enzymes for the consumption of kynurenine. In one embodiment, the STING agonist produced is c-di-AMP. In one embodiment, the composition comprises genetically engineered bacteria comprising gene sequences encoding a diadenylate cyclase and genetically engineered bacteria comprising gene sequences encoding a kynureninase. In one embodiment, the diadenylate cyclase is from *Listeria monocytogenes*. In one embodiment, the kynureninase is from *Pseudomonas fluorescens*. In one specific embodiment, the diadenylate cyclase is from *Listeria monocytogenes* and the kynureninase is from *Pseudomonas fluorescens*. In one embodiment, the STING agonist produced is cyclic-di-GAMP. In one embodiment, the composition comprises genetically engineered bacteria comprising gene sequences encoding a c-di-GAMP synthase and genetically engineered bacteria comprising gene sequences encoding a kynureninase. In one embodiment, the c-di-GAMP synthases is from *Vibrio cholerae*. In one embodiment, the kynureninase is from *Pseudomonas fluorescens*. In one specific embodiment, the c-di-GAMP synthase is from *Vibrio cholerae* and the kynureninase is from *Pseudomonas fluorescens*. In one specific embodiment, the kynureninase from *Pseudomonas fluorescens* is chromosomally integrated and under control of a constitutive promoter.

In any of these STING agonist production and kynurenine consumption embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more STING agonist, e.g., cyclic-di-AMP, than unmodified bacteria of the same bacterial subtype under the same conditions.

In any of these STING agonist production and kynurenine consumption embodiments, the genetically engineered bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more kynurenine than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more STING agonist, e.g., cyclic-di-AMP, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more STING agonist, e.g., cyclic-di-AMP, than unmodified bacteria of the same bacterial subtype under the same conditions.

In yet another embodiment, the genetically engineered bacteria consume 1.0-1.2-fold, 1.2-1.4-fold, 1.4-1.6-fold, 1.6-1.8-fold, 1.8-2-fold, or two-fold more kynurenine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more kynurenine than unmodified bacteria of the same bacterial subtype under the same conditions.

In any of these STING agonist production and kynurenine consumption embodiments, the genetically engineered bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more ATP than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more ATP than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more ATP than unmodified bacteria of the same bacterial subtype under the same conditions.

In any of these STING agonist production and kynurenine consumption embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more tryptophan than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more tryptophan than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more tryptophan than unmodified bacteria of the same bacterial subtype under the same conditions.

In any of these embodiments, the genetically engineered bacteria increase the kynurenine consumption rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the genetically engineered bacteria increase the kynurenine consumption rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase the kynurenine consumption rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one embodiment, the genetically engineered bacteria increase the kynurenine consumption by about 80% to 100% relative to unmodified bacteria of the same bacterial subtype under the same conditions, after 4 hours. In one embodiment, the genetically engineered bacteria increase the kynurenine consumption by about 90% to 100% relative to unmodified bacteria of the same bacterial subtype under the same conditions after 4 hours. In one specific embodiment, the genetically engineered bacteria increase the kynurenine consumption by about 95% to 100% relative to unmodified bacteria of the same bacterial subtype under the same conditions, after 4 hours. In one specific embodiment, the genetically engineered bacteria increase the kynurenine consumption by about 99% to 100% relative to unmodified bacteria of the same bacterial subtype under the same conditions, after 4 hours. In yet another embodiment, the genetically engineered bacteria increase the kynurenine consumption by about 10-50 fold after 4 hours. In yet another embodiment, the genetically engineered bacteria increase the kynurenine consumption by about 50-100 fold after 4 hours. In yet another embodiment, the genetically engineered bacteria increase the kynurenine consumption by about 100-500 fold after 4 hours. In yet another embodiment, the genetically engineered bacteria increase the kynurenine consumption by about 500-1000 fold after 4 hours. In yet another embodiment, the genetically engineered bacteria increase the kynurenine consumption by about 1000-5000 fold after 4 hours. In yet another embodiment, the genetically engineered bacteria increase the kynurenine consumption by about 5000-10000 fold after 4 hours. In yet another embodiment, the genetically engineered bacteria increase the kynurenine consumption by about 10000-1000 fold after 4 hours.

In any of these embodiments, the genetically engineered bacteria increase STING agonist production rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the genetically engineered bacteria increase the STING agonist production rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase STING agonist production rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one embodiment, the genetically engineered bacteria increase STING agonist production by about 80% to 100% relative to unmodified bacteria of the same bacterial subtype under the same conditions, after 4 hours. In one embodiment, the genetically engineered bacteria increase STING agonist production by about 90% to 100% relative to unmodified bacteria of the same bacterial subtype under the same conditions after 4 hours. In one specific embodiment, the genetically engineered bacteria increase STING agonist production by about 95% to 100% relative to unmodified bacteria of the same bacterial subtype under the same conditions, after 4 hours. In one specific embodiment, the genetically engineered bacteria increase the STING agonist production by about 99% to 100% relative to unmodified bacteria of the same bacterial subtype under the same conditions, after 4 hours. In yet another embodiment, the genetically engineered bacteria increase the STING agonist production by about 10-50 fold after 4 hours. In yet another embodiment, the genetically engineered bacteria increase STING agonist production by about 50-100 fold after 4 hours. In yet another embodiment, the genetically engineered bacteria increase STING agonist production by about 100-500 fold after 4 hours. In yet another embodiment, the genetically engineered bacteria increase STING agonist production by about 500-1000 fold after 4 hours. In yet another embodiment, the genetically engineered bacteria increase the STING agonist production by about 1000-5000 fold after 4 hours. In yet another embodiment, the genetically engineered bacteria increase the STING agonist production by about 5000-10000 fold after 4 hours. In yet another embodiment, the genetically engineered bacteria increase STING agonist production by about 10000-1000 fold after 4 hours.

In any of these STING agonist production and kynurenine consumption embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and kynurenine consumption embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and kynurenine consumption embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and kynurenine consumption embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and kynurenine consumption embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In one embodiment, the genetically engineered bacteria comprise one or more genes encoding enzymes for the production of STING agonist(s) in combination with one or more genes encoding enzymes for the consumption of adenosine. In one embodiment, the STING agonist produced is c-di-AMP. In one embodiment, the genetically engineered bacteria comprises gene sequences encoding a diadenylate cyclase in combination with gene sequences encoding an adenosine degradation pathway. In one embodiment, the diadenylate cyclase is from *Listeria monocytogenes*. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the diadenylate cyclase is from *Listeria monocytogenes* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR.

In one embodiment, the STING agonist produced is cyclic-di-GAMP. In one embodiment, the genetically engineered bacteria comprises gene sequences encoding a c-di-GAMP synthase in combination with gene sequences encoding a adenosine degradation pathway. In one embodiment, the c-di-GAMP synthases is from *Vibrio cholerae*. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the c-di-GAMP synthase is from *Vibrio cholerae* and the gene sequences encoding the adenosine degradation pathway comprise xdhA, xdhB, xdhC, add, xapA, deoD, and nupC, e.g., from *E. coli*. In one specific embodiment, the genes encoding the adenosine degradation pathway are chromosomally integrated and under control of a low-oxygen promoter, e.g., FNR.

In alternate embodiments, the disclosure provides a composition comprising a combination (e.g., two or more) of different genetically engineered bacteria, each bacteria encoding a different immune modulator. Accordingly, in one embodiment, the composition comprises genetically engineered bacteria comprising one or more genes encoding enzymes for the production of STING agonist(s) in combination with comprises genetically engineered bacteria comprising one or more genes encoding enzymes for the consumption of adenosine. In one embodiment, the STING agonist produced is c-di-AMP. In one embodiment, the composition comprises genetically engineered bacteria comprising gene sequences encoding a diadenylate cyclase in combination with genetically engineered bacteria comprising gene sequences encoding an adenosine degradation pathway. In one embodiment, the diadenylate cyclase is from *Listeria monocytogenes*. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the diadenylate cyclase is from *Listeria monocytogenes* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR.

In one embodiment, the STING agonist produced is cyclic-di-GAMP. In one embodiment, the composition comprises genetically engineered bacteria comprising gene sequences encoding a c-di-GAMP synthase in combination with genetically engineered bacteria comprising gene sequences encoding an adenosine degradation pathway. In one embodiment, the c-di-GAMP synthases is from *Vibrio cholerae*. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the c-di-GAMP synthase is from *Vibrio cholerae* and the gene sequences encoding the adenosine degradation pathway comprise xdhA, xdhB, xdhC, add, xapA, deoD, and nupC, e.g., from *E. coli*. In one specific embodiment, the genes encoding the adenosine degradation pathway are chromosomally integrated and under control of a low-oxygen promoter, e.g., FNR.

In any of these STING agonist production and adenosine consumption embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more STING agonist, e.g., cyclic-di-AMP, than unmodified bacteria of the same bacterial subtype under the same conditions.

In any of these STING agonist production and adenosine consumption embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more adenosine than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more STING agonist, e.g., cyclic-di-AMP, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more STING agonist, e.g., cyclic-di-AMP, than unmodified bacteria of the same bacterial subtype under the same conditions.

In yet another embodiment, the genetically engineered bacteria consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more adenosine than unmodified bacteria of the same bacterial subtype under the same conditions.

In any of these STING agonist production and adenosine consumption embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more ATP than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more ATP than unmodified bacteria of the same bacterial subtype under the same conditions.

In any of these STING agonist production and adenosine consumption embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more urate than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more urate than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more urate than unmodified bacteria of the same bacterial subtype under the same conditions.

In any of these STING agonist production and adenosine consumption embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and adenosine consumption embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and adenosine consumption embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and adenosine consumption embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and adenosine consumption embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In one embodiment, the genetically engineered bacteria comprise one or more genes encoding enzymes for the production of STING agonist(s) in combination with one or more genes encoding enzymes for the production of arginine. In one embodiment, the STING agonist produced is c-di-AMP. In one embodiment, the genetically engineered bacteria comprises gene sequences encoding a diadenylate cyclase in combination with gene sequences encoding an arginine production pathway. In one embodiment, the diadenylate cyclase is from *Listeria monocytogenes*. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR.

In alternate embodiments, the disclosure provides a composition comprising a combination (e.g., two or more) of different genetically engineered bacteria, each bacteria encoding a different immune modulator. Accordingly, in one embodiment, the composition comprises genetically engineered bacteria comprising one or more genes encoding enzymes for the production of STING agonist(s) in combination with genetically engineered bacteria comprising one or more genes encoding enzymes for the production of arginine. In one embodiment, the STING agonist produced is c-di-AMP. In one embodiment, the composition comprises genetically engineered bacteria comprising gene sequences encoding a diadenylate cyclase in combination with genetically engineered bacteria comprising gene sequences encoding an arginine production pathway. In one embodiment, the diadenylate cyclase is from *Listeria monocytogenes*. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR.

In any of these STING agonist production and arginine production embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more STING agonist, e.g., cyclic-di-AMP, than unmodified bacteria of the same bacterial subtype under the same conditions.

In any of these STING agonist production and arginine production embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more STING agonist, e.g., cyclic-di-AMP, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more STING agonist, e.g., cyclic-di-AMP, than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more arginine than unmodified bacteria of the same bacterial subtype under the same conditions.

In any of these STING agonist production and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more ATP than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these STING agonist production and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more glutamate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more glutamate than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these STING agonist production and arginine production embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and arginine production embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and arginine production embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and arginine production embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and arginine production embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In one embodiment, the genetically engineered bacteria comprise one or more genes encoding enzymes for the conversion of 5-FC to 5-FU in combination with one or more genes encoding enzymes for the consumption of kynurenine. In one embodiment, the genetically engineered bacteria comprises gene sequences encoding a cytosine deaminase in combination with gene sequences encoding a kynureninase. In one embodiment, the cytosine deaminase is from *E. coli*. In one embodiment, the cytosine deaminase is from yeast. In one embodiment, the kynureninase is from *Pseudomonas fluorescens*. In one specific embodiment, the cytosine deaminase is from *E. coli* and the kynureninase is from *Pseudomonas fluorescens*. In one embodiment, the kynureninase is from *Pseudomonas fluorescens*. In one specific embodiment, the kynureninase from *Pseudomonas fluorescens* is chromosomally integrated and under control of a constitutive promoter.

In alternate embodiments, the disclosure provides a composition comprising a combination (e.g., two or more) of different genetically engineered bacteria, each bacteria encoding a different immune modulator. Accordingly, in one embodiment, the composition comprises genetically engineered bacteria comprising one or more genes encoding enzymes for the conversion of 5-FC to 5-FU in combination with genetically engineered bacteria comprising one or more genes encoding enzymes for the consumption of kynurenine. In one embodiment, the composition comprises genetically engineered bacteria comprising gene sequences encoding a cytosine deaminase in combination with genetically engineered bacteria comprising gene sequences encoding a kynureninase. In one embodiment, the cytosine deaminase is from *E. coli*. In one embodiment, the cytosine deaminase is from yeast. In one embodiment, the kynureninase is from *Pseudomonas fluorescens*. In one specific embodiment, the cytosine deaminase is from *E. coli* and the kynureninase is from *Pseudomonas fluorescens*. In one embodiment, the kynureninase is from *Pseudomonas fluorescens*. In one specific embodiment, the kynureninase from *Pseudomonas fluorescens* is chromosomally integrated and under control of a constitutive promoter.

In any of these 5-FC to 5-FU conversion and kynurenine consumption embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more STING agonist, e.g., cyclic-di-AMP, than unmodified bacteria of the same bacterial subtype under the same conditions.

In any of these 5-FC to 5-FU conversion and kynurenine consumption embodiments, the genetically engineered bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more kynurenine than unmodified bacteria of the same bacterial subtype under the same conditions.

In yet another embodiment, the genetically engineered bacteria convert 1.0-1.2-fold, 1.2-1.4-fold, 1.4-1.6-fold, 1.6-1.8-fold, 1.8-2-fold, or two-fold more 5-FC into 5-FU, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more 5-FU, than unmodified bacteria of the same bacterial subtype under the same conditions.

In yet another embodiment, the genetically engineered bacteria consume 1.0-1.2-fold, 1.2-1.4-fold, 1.4-1.6-fold, 1.6-1.8-fold, 1.8-2-fold, or two-fold more kynurenine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more kynurenine than unmodified bacteria of the same bacterial subtype under the same conditions.

In any of these 5-FC to 5-FU conversion and kynurenine consumption embodiments, the genetically engineered bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more 5-FC than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more 5-FC than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more 5-FC than unmodified bacteria of the same bacterial subtype under the same conditions.

In any of these 5-FC to 5-FU conversion and kynurenine consumption embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more tryptophan than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more tryptophan than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more tryptophan than unmodified bacteria of the same bacterial subtype under the same conditions.

In any of these 5-FC to 5-FU conversion and kynurenine consumption embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and kynurenine consumption embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and kynurenine consumption embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and kynurenine consumption embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and kynurenine consumption embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In one embodiment, the genetically engineered bacteria comprise one or more genes encoding enzymes for the conversion of 5-FC to 5-FU in combination with one or more genes encoding enzymes for the consumption of adenosine. In one embodiment, the genetically engineered bacteria comprises gene sequences encoding a cytosine deaminase in combination with gene sequences encoding an adenosine degradation pathway. In one embodiment, the cytosine deaminase is from *E. coli*. In one embodiment, the cytosine deaminase is from yeast. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the cytosine deaminase is from *E. coli* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR.

In alternate embodiments, the disclosure provides a composition comprising a combination (e.g., two or more) of different genetically engineered bacteria, each bacteria encoding a different immune modulator. Accordingly, in one embodiment, the composition comprises genetically engineered bacteria comprising one or more genes encoding enzymes for the conversion of 5-FC to 5-FU in combination with one or more genes encoding enzymes for the consumption of adenosine. In one embodiment, the composition comprises genetically engineered bacteria comprising gene sequences encoding a cytosine deaminase in combination with genetically engineered bacteria comprising gene sequences encoding an adenosine degradation pathway. In one embodiment, the cytosine deaminase is from *E. coli*. In one embodiment, the cytosine deaminase is from yeast. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the cytosine deaminase is from *E. coli* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR.

In any of these 5-FC to 5-FU conversion and adenosine consumption embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more STING agonist, e.g., cyclic-di-AMP, than unmodified bacteria of the same bacterial subtype under the same conditions.

In any of these 5-FC to 5-FU conversion and adenosine consumption embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more adenosine than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more 5-FU, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more 5-FU, than unmodified bacteria of the same bacterial subtype under the same conditions.

In yet another embodiment, the genetically engineered bacteria consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more adenosine than unmodified bacteria of the same bacterial subtype under the same conditions.

In any of these 5-FC to 5-FU conversion and adenosine consumption embodiments, the genetically engineered bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more 5-FC than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more 5-FC than unmodified bacteria of the same bacterial subtype under the same conditions.

In any of these 5-FC to 5-FU conversion and adenosine consumption embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more urate than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more urate than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more urate than unmodified bacteria of the same bacterial subtype under the same conditions.

In any of these 5-FC to 5-FU conversion and adenosine consumption embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these STING agonist production and adenosine consumption embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and adenosine consumption embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and adenosine consumption embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and adenosine consumption embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In one embodiment, the genetically engineered bacteria comprise one or more genes encoding enzymes for the production 5-FU in combination with one or more genes encoding enzymes for the production of arginine. In one embodiment, the genetically engineered bacteria comprises gene sequences encoding a cytosine deaminase in combination with gene sequences encoding an arginine production pathway. In one embodiment, the cytosine deaminase is from *E. coli*. In one embodiment, the cytosine deaminase is from yeast. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR.

In alternate embodiments, the disclosure provides a composition comprising a combination (e.g., two or more) of different genetically engineered bacteria, each bacteria encoding a different immune modulator. Accordingly, in one embodiment, the composition comprises genetically engineered bacteria comprising one or more genes encoding enzymes for the production 5-FU in combination with genetically engineered bacteria comprising one or more genes encoding enzymes for the production of arginine. In one embodiment, the composition comprises genetically engineered bacteria comprising gene sequences encoding a cytosine deaminase in combination with genetically engineered bacteria comprising gene sequences encoding an arginine production pathway. In one embodiment, the cytosine deaminase is from *E. coli*. In one embodiment, the cytosine deaminase is from yeast. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR.

In any of these 5-FC to 5-FU conversion and arginine production embodiments, the genetically engineered bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more 5-FU, than unmodified bacteria of the same bacterial subtype under the same conditions.

In any of the 5-FC to 5-FU conversion and arginine production embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more 5-FU, than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more 5-FU than unmodified bacteria of the same bacterial subtype under the same conditions.

In yet another embodiment, the genetically engineered bacteria produce at least about 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more arginine than unmodified bacteria of the same bacterial subtype under the same conditions.

In any of these 5-FC to 5-FU conversion and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more 5-FC than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more 5-FC than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more 5FC than unmodified bacteria of the same bacterial subtype under the same conditions.

In any of these 5-FC to 5-FU conversion and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more glutamate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more glutamate than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these 5-FC to 5-FU conversion and arginine production embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and arginine production embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and arginine production embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and arginine production embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these 5-FC to 5-FU conversion and arginine production embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In any of these embodiments combining immune activation and priming with immune augmentation, the gene sequence(s) encoding effectors for targeting immune activation and priming and the gene sequence(s) encoding effectors for immune augmentation may be operably linked to one or more directly or indirectly inducible promoter(s). In some embodiments, the two or more gene sequence(s) are operably linked to a directly or indirectly inducible promoter that is induced under exogenous environmental conditions, e.g., conditions found in the gut, the tumor microenvironment or other tissue specific conditions. In some embodiments, the two or more gene sequence(s) are operably linked to a directly or indirectly inducible promoter that is induced by metabolites found in the gut, the tumor microenvironment or other specific conditions. In some embodiments, the two or more gene sequence(s) are operably linked to a directly or indirectly inducible promoter that is induced under low-oxygen or anaerobic conditions. In some embodiments, the two or more gene sequence(s) are operably linked to a directly or indirectly inducible promoter that is induced under inflammatory conditions (e.g., RNS, ROS), as described herein. In some embodiments, the two or more gene sequence(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Suitable constitutive promoters are described herein. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In any of the above immune activation and immune augmentation combination embodiments, the gene sequence(s) for producing the one or more immune activation and immune augmentation effectors may be present on a chromosome in the bacterium. In any of the above combination embodiments, the gene sequence(s) for producing the one or more immune activation and immune augmentation effectors may be present on a plasmid in the bacterium. In any of the above combination embodiments, the gene sequence(s) for producing the one or more immune activation and immune augmentation effectors may be present both on a plasmid and the chromosome in the bacterium. In any of the above combination embodiments, the bacterium may be an auxotroph comprising a deletion or mutation in a gene required for cell survival and/or growth, e.g., wherein the gene is selected from thyA, dapD, and dapA. In any of the above combination embodiment, the genetically engineered bacterium may comprise a kill switch.

In some immune initiator and sustainer combinations and/or compositions, the genetically engineered microorganisms are capable of expressing any one or more of the described immune initiator circuits and immune sustainer circuits for the in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some immune initiator and sustainer combinations and/or compositions, the gene sequences(s) encoding circuitry for immune initiators and immune sustainers are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In any of these immune initiator and sustainer combinations and/or compositions, any one or more of the immune initiator circuits and immune sustainer circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the bacteria genetically engineered to consume adenosine and kynurenine may be administered alone or in combination with one or more immune checkpoint inhibitors described herein, including but not limited anti-CTLA4, anti-PD1, or anti-PD-L1 antibodies.

Combinations of Metabolic Circuits

Adenosine and Kynurenine Consumption

In some embodiments, the genetically engineered bacteria comprise circuitry that produces and/or consumes one or more metabolites. Alternatively, the disclosure provides a composition comprising a combination (e.g., two or more) of different genetically engineered bacteria, each bacteria encoding one or more enzymes for the production and/or consumption of one or more metabolic substrates. Non-limiting examples of such substrates include kynurenine, tryptophan, adenosine and arginine.

In some embodiments, the genetically engineered bacteria comprise circuitry for the degradation of adenosine and the consumption of kynurenine. In one embodiment, the genetically engineered bacteria comprise gene sequences encoding kynureninase in combination with an adenosine degradation pathway. In one embodiment, the kynureninase is from

*Pseudomonas fluorescens*. In one specific embodiment, the kynureninase from *Pseudomonas fluorescens* is chromosomally integrated and under control of a constitutive promoter. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the kynureninase is from *Pseudomonas fluorescens* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR. In any of these embodiments, TrpE may be deleted.

In alternate embodiments, the disclosure provides a composition comprising a combination (e.g., two or more) of different genetically engineered bacteria, each bacteria encoding a different immune modulator. Accordingly, in some embodiments, the composition comprises genetically engineered bacteria comprising circuitry for the degradation of adenosine and genetically engineered bacteria the consumption of kynurenine. In one embodiment, the composition comprises genetically engineered bacteria comprising gene sequences encoding kynureninase in combination with genetically engineered bacteria comprising gene sequences encoding an adenosine degradation pathway. In any of these embodiments, TrpE may be deleted.

In one embodiment, the kynureninase is from *Pseudomonas fluorescens*. In one specific embodiment, the kynureninase from *Pseudomonas fluorescens* is chromosomally integrated and under control of a constitutive promoter. In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from *E coli*. In one specific embodiment, the kynureninase is from *Pseudomonas fluorescens* and the gene sequences encoding the adenosine degradation pathway comprise xdhA, xdhB, xdhC, add, xapA, deoD, and nupC, e.g., from *E. coli*. In on specific embodiment, the adenosine pathway enzymes are integrated into the chromosome and are under the control of a low-oxygen promoter, e.g., FNR. In any of these embodiments, TrpE may be deleted.

In any of these adenosine and kynurenine consumption embodiments, the bacteria genetically engineered to consume adenosine and kynurenine consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more adenosine than unmodified bacteria of the same bacterial subtype under the same conditions. In yet another embodiment, the bacteria genetically engineered to consume adenosine and kynurenine consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, bacteria genetically engineered to consume adenosine and kynurenine consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more adenosine than unmodified bacteria of the same bacterial subtype under the same conditions.

In any of these adenosine and kynurenine consumption embodiments, the bacteria genetically engineered to consume adenosine and kynurenine produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more urate than unmodified bacteria of the same bacterial subtype under the same conditions. In yet another embodiment, the bacteria genetically engineered to consume adenosine and kynurenine produce at least about 1.0-1.2-fold, 1.2-1.4-fold, 1.4-1.6-fold, 1.6-1.8-fold, 1.8-2-fold, or two-fold more urate than unmodified bacteria of the same bacterial subtype under the same conditions. In yet another embodiment, the bacteria genetically engineered to consume adenosine and kynurenine produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more urate than unmodified bacteria of the same bacterial subtype under the same conditions.

In any of these adenosine and kynurenine consumption embodiments, the bacteria genetically engineered to consume adenosine and kynurenine increase the adenosine degradation rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the bacteria genetically engineered to consume adenosine and kynurenine increase the adenosine degradation rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the bacteria genetically engineered to consume adenosine and kynurenine increase the degradation rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In any of these adenosine and kynurenine consumption embodiments, the bacteria genetically engineered to consume adenosine and kynurenine may have an adenosine degradation rate of about 1.8-10 umol/hr/10^9 cells when induced under low oxygen conditions. In one specific embodiment, the bacteria genetically engineered to consume adenosine and kynurenine have an adenosine degradation rate of about 5-9 umol/hr/10^9 cells. In one specific embodiment, the bacteria genetically engineered to consume adenosine and kynurenine have an adenosine degradation rate of about 6-8 umol/hr/10^9 cells.

In any of these adenosine and kynurenine consumption embodiments, the bacteria genetically engineered to consume adenosine and kynurenine may increase the adenosine degradation by about 50% to 70% relative to unmodified bacteria of the same bacterial subtype under the same conditions, i.e., when induced under low oxygen conditions, after 1 hour. In one embodiment, the bacteria genetically engineered to consume adenosine and kynurenine increase the adenosine degradation by about 55% to 65% relative to unmodified bacteria of the same bacterial subtype under the same conditions, i.e., when induced under low oxygen conditions after 1 hour. In one specific embodiment, the bacteria genetically engineered to consume adenosine and kynurenine increase the adenosine degradation by about 55% to 60% relative to unmodified bacteria of the same bacterial subtype under the same conditions, i.e., when induced under low oxygen conditions, after 1 hour. In yet another embodiment, the bacteria genetically engineered to consume adenosine and kynurenine increase the adenosine degradation by about 1.5-3 fold when induced under low oxygen conditions, after 1 hour. In one specific embodiment, the bacteria genetically engineered to consume adenosine and kynurenine increase the adenosine degradation by about 2-2.5 fold when induced under low oxygen conditions, after 1 hour.

In one adenosine and kynurenine consumption embodiment, the bacteria increase the adenosine degradation by about 85% to 100% relative to unmodified bacteria of the same bacterial subtype under the same conditions, i.e., when induced under low oxygen conditions, after 2 hours. In one embodiment, the bacteria genetically engineered to consume adenosine and kynurenine increase the adenosine degradation by about 95% to 100% relative to unmodified bacteria of the same bacterial subtype under the same conditions, i.e., when induced under low oxygen conditions after 2 hours. In one specific embodiment, the bacteria genetically engineered to consume adenosine and kynurenine increase the adenosine degradation by about 97% to 99% relative to unmodified bacteria of the same bacterial subtype under the same conditions, i.e., when induced under low oxygen conditions, after 2 hours.

In one adenosine and kynurenine consumption embodiment, the bacteria genetically engineered to consume adenosine and kynurenine may increase the adenosine degradation by about 40-50 fold when induced under low oxygen conditions, after 2 hours. In one specific embodiment, the bacteria genetically engineered to consume adenosine and kynurenine increase the adenosine degradation by about 44-48 fold when induced under low oxygen conditions, after 2 hours.

In one adenosine and kynurenine consumption embodiment, the bacteria genetically engineered to consume adenosine and kynurenine increase the adenosine degradation by about 95% to 100% relative to unmodified bacteria of the same bacterial subtype under the same conditions, i.e., when induced under low oxygen conditions, after 3 hours. In one embodiment, the bacteria genetically engineered to consume adenosine and kynurenine increase the adenosine degradation by about 98% to 100% relative to unmodified bacteria of the same bacterial subtype under the same conditions, i.e., when induced under low oxygen conditions after 3 hours. In one specific embodiment, the bacteria genetically engineered to consume adenosine and kynurenine increase the adenosine degradation by about 99% to 99% relative to unmodified bacteria of the same bacterial subtype under the same conditions, i.e., when induced under low oxygen conditions, after 3 hours. In yet another embodiment, the bacteria genetically engineered to consume adenosine and kynurenine increase the adenosine degradation by about 100-1000 fold when induced under low oxygen conditions, after 3 hours. In yet another embodiment, the bacteria genetically engineered to consume adenosine and kynurenine increase the adenosine degradation by about 1000-10000 fold when induced under low oxygen conditions, after 3 hours.

In one adenosine and kynurenine consumption embodiment, the bacteria genetically engineered to consume adenosine and kynurenine increase the adenosine degradation by about 95% to 100% relative to unmodified bacteria of the same bacterial subtype under the same conditions, i.e., when induced under low oxygen conditions, after 4 hours. In one embodiment, the bacteria genetically engineered to consume adenosine and kynurenine increase the adenosine degradation by about 98% to 100% relative to unmodified bacteria of the same bacterial subtype under the same conditions, i.e., when induced under low oxygen conditions after 4 hours. In one embodiment, the bacteria genetically engineered to consume adenosine and kynurenine increase the adenosine degradation by about 99% to 99% relative to unmodified bacteria of the same bacterial subtype under the same conditions, i.e., when induced under low oxygen conditions, after 4 hours. In yet another embodiment, the bacteria genetically engineered to consume adenosine and kynurenine increase the adenosine degradation by about 100-1000 fold when induced under low oxygen conditions, after 4 hours. In yet another embodiment, the bacteria genetically engineered to consume adenosine and kynurenine increase the adenosine degradation by about 1000-10000 fold when induced under low oxygen conditions, after 4 hours.

In any of these adenosine and kynurenine consumption embodiments, the bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more kynurenine than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more kynurenine than unmodified bacteria of the same bacterial subtype under the same conditions. In yet another embodiment, the genetically engineered bacteria consume about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more kynurenine than unmodified bacteria of the same bacterial subtype under the same conditions.

In any of these adenosine and kynurenine consumption embodiments, the bacteria genetically engineered to consume kynurenine and optionally produce tryptophan produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more tryptophan than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more tryptophan than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousandfold more tryptophan than unmodified bacteria of the same bacterial subtype under the same conditions.

In any of these adenosine and kynurenine consumption embodiments, the genetically engineered bacteria increase the kynurenine consumption rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another adenosine and kynurenine consumption embodiment, the genetically engineered bacteria increase the kynurenine consumption rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase the kynurenine consumption rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one adenosine and kynurenine consumption embodiment, the genetically engineered bacteria increase the kynurenine consumption by about 80% to 100% relative to unmodified bacteria of the same bacterial subtype under the same conditions, after 4 hours. In one adenosine and kynurenine consumption embodiment, the genetically engineered bacteria increase the kynurenine consumption by about 90% to 100% relative to unmodified bacteria of the same bacterial subtype under the same conditions after 4 hours. In one specific adenosine and kynurenine consumption embodiment, the genetically engineered bacteria increase the kynurenine consumption by about 95% to 100% relative to unmodified bacteria of the same bacterial subtype under the same conditions, after 4 hours. In one specific embodiment, the genetically engineered bacteria increase the kynurenine consumption by about 99% to 100% relative to unmodified bacteria of the same bacterial subtype under the same conditions, after 4 hours. In yet another embodiment, the genetically engineered bacteria increase the kynurenine consumption by about 10-50 fold after 4 hours. In yet another embodiment, the genetically engineered bacteria increase the kynurenine consumption by about 50-100 fold after 4 hours. In yet another embodiment, the genetically engineered bacteria increase the kynurenine consumption by about 100-500 fold after 4 hours. In yet another embodiment, the genetically engineered bacteria increase the kynurenine consumption by about 500-1000 fold after 4 hours. In yet another embodiment, the genetically engineered bacteria increase the kynurenine consumption by about 1000-5000 fold after 4 hours. In yet another embodiment, the genetically engineered bacteria increase the kynurenine consumption by about 5000-10000 fold after 4 hours. In yet another embodiment, the genetically engineered bacteria increase the kynurenine consumption by about 10000-1000 fold after 4 hours.

In any of these adenosine and kynurenine consumption embodiments, the genetically engineered bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these adenosine and kynurenine consumption embodiments, the genetically engineered bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these adenosine and kynurenine consumption embodiments, the genetically engineered bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these adenosine and kynurenine consumption embodiments, the genetically engineered bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these adenosine and kynurenine consumption embodiments, the genetically engineered bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some adenosine and kynurenine consumption embodiments, the genetically engineered microorganisms are capable of expressing any one or more of the described circuits for the degradation of adenosine and kynurenine in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding circuitry for the degradation of adenosine and/or kynurenine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In any of these adenosine and kynurenine consumption embodiments, any one or more of the described adenosine degradation circuits and kynurenine consumption circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine)

described herein (8) combinations of one or more of such additional circuits. In any of these embodiments, the bacteria genetically engineered to consume adenosine and kynurenine may be administered alone or in combination with one or more immune checkpoint inhibitors described herein, including but not limited anti-CTLA4, anti-PD1, or anti-PD-L1 antibodies.

Adenosine Consumption and Arginine Production

In some embodiments, the genetically engineered bacteria comprise circuitry for the degradation of adenosine and the production of arginine. In one embodiment, the genetically engineered bacteria comprise gene sequences encoding an arginine production circuit in combination with an adenosine degradation pathway. In one embodiment, the gene sequences encoding the arginine production circuit comprise feedback resistant ArgA (ArgAfbr) and a deletion in the endogenous arginine operon repressor ArgR. In one embodiment, the ArgAfbr is from $E$ $coli$. In one specific embodiment, ArgAfbr is integrated into the chromosome and is under the control of a low-oxygen promoter, e.g., FNR.

In one embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from $E$ $coli$. In one specific embodiment, the diadenylate cyclase is from $Listeria$ $monocytogenes$ and the gene sequences encoding the adenosine degradation pathway comprise xdhA, xdhB, xdhC, add, xapA, deoD, and nupC, e.g., from $E.$ $coli$. In on specific embodiment, the adenosine pathway enzymes are integrated into the chromosome and are under the control of a low-oxygen promoter, e.g., FNR.

In alternate embodiments, the disclosure provides a composition comprising a combination (e.g., two or more) of different genetically engineered bacteria, each bacteria encoding a different immune modulator. Accordingly, in some embodiments, the composition comprises genetically engineered bacteria comprising circuitry for the degradation of adenosine and genetically engineered bacteria comprising sequences for the production of arginine. In one embodiment, the composition comprises genetically engineered bacteria comprising gene sequences encoding feedback resistant ArgA (ArgAfbr) and a deletion in the endogenous arginine operon repressor ArgR in combination with genetically engineered bacteria comprising gene sequences encoding an adenosine degradation pathway.

In one composition embodiment, the ArgAfbr is from $E$ $coli$. In one specific embodiment, ArgAfbr is integrated into the chromosome and is under the control of a low-oxygen promoter, e.g., FNR. In one composition embodiment, the gene sequences encoding the adenosine degradation pathway enzymes comprise one or more genes selected from xdhA, xdhB, xdhC, add, xapA, deoD, and nupC. In one embodiment, the gene sequences encoding the adenosine degradation pathway comprise xdhA, xdhB, xdhC, add, xapA, deoD, and nupC. In one embodiment, the adenosine pathway enzymes are from $E$ $coli$. In one specific embodiment, the diadenylate cyclase is from $Listeria$ $monocytogenes$ and the gene sequences encoding the adenosine degradation pathway comprise xdhA, xdhB, xdhC, add, xapA, deoD, and nupC, e.g., from $E.$ $coli$. In on specific embodiment, the adenosine pathway enzymes are integrated into the chromosome and are under the control of a low-oxygen promoter, e.g., FNR.

In any of these adenosine consumption and arginine production embodiments, the bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more adenosine than unmodified bacteria of the same bacterial subtype under the same conditions. In yet another embodiment, the bacteria consume 1.0-1.2-fold, 1.2-1.4-fold, 1.4-1.6-fold, 1.6-1.8-fold, 1.8-2-fold, or two-fold more adenosine than unmodified bacteria of the same bacterial subtype under the same conditions. In yet another embodiment, bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more adenosine than unmodified bacteria of the same bacterial subtype under the same conditions.

In any of these adenosine consumption and arginine production embodiments, the bacteria produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more urate than unmodified bacteria of the same bacterial subtype under the same conditions. In yet another embodiment, the bacteria produce at least about 1.0-1.2-fold, 1.2-1.4-fold, 1.4-1.6-fold, 1.6-1.8-fold, 1.8-2-fold, or two-fold more urate than unmodified bacteria of the same bacterial subtype under the same conditions. In yet another embodiment, the bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more urate than unmodified bacteria of the same bacterial subtype under the same conditions.

In any of these adenosine consumption and arginine production embodiments, the bacteria increase the adenosine degradation rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another embodiment, the bacteria increase the adenosine degradation rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the bacteria increase the degradation rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In any of these adenosine consumption and arginine production embodiments, the bacteria may have an adenosine degradation rate of about 1.8-10 umol/hr/10^9 cells when induced under low oxygen conditions. In one specific embodiment, the bacteria have an adenosine degradation rate of about 5-9 umol/hr/10^9 cells. In one specific embodiment, the bacteria have an adenosine degradation rate of about 6-8 umol/hr/10^9 cells.

In any of these adenosine consumption and arginine production embodiments, the bacteria may increase the adenosine degradation by about 50% to 70% relative to unmodified bacteria of the same bacterial subtype under the same conditions, i.e., when induced under low oxygen conditions, after 1 hour. In one embodiment, the bacteria increase the adenosine degradation by about 55% to 65% relative to unmodified bacteria of the same bacterial subtype under the same conditions, i.e., when induced under low oxygen conditions after 1 hour. In one specific embodiment, the bacteria increase the adenosine degradation by about 55% to 60% relative to unmodified bacteria of the same bacterial subtype under the same conditions, i.e., when induced under low oxygen conditions, after 1 hour. In yet another embodiment, the bacteria increase the adenosine degradation by about 1.5-3 fold when induced under low oxygen conditions, after 1 hour. In one specific embodiment, the bacteria increase the adenosine degradation by about 2-2.5 fold when induced under low oxygen conditions, after 1 hour.

In one adenosine consumption and arginine production embodiment, the bacteria increase the adenosine degradation by about 85% to 100% relative to unmodified bacteria of the same bacterial subtype under the same conditions, i.e., when induced under low oxygen conditions, after 2 hours. In one embodiment, the bacteria increase the adenosine degradation by about 95% to 100% relative to unmodified bacteria of the same bacterial subtype under the same conditions, i.e., when induced under low oxygen conditions after 2 hours. In one specific embodiment, the bacteria increase the adenosine degradation by about 97% to 99% relative to unmodified bacteria of the same bacterial subtype under the same conditions, i.e., when induced under low oxygen conditions, after 2 hours.

In one adenosine consumption and arginine production embodiment, the bacteria may increase the adenosine degradation by about 40-50 fold when induced under low oxygen conditions, after 2 hours. In one specific embodiment, the bacteria increase the adenosine degradation by about 44-48 fold when induced under low oxygen conditions, after 2 hours.

In one adenosine consumption and arginine production embodiment, the bacteria increase the adenosine degradation by about 95% to 100% relative to unmodified bacteria of the same bacterial subtype under the same conditions, i.e., when induced under low oxygen conditions, after 3 hours. In one embodiment, the bacteria increase the adenosine degradation by about 98% to 100% relative to unmodified bacteria of the same bacterial subtype under the same conditions, i.e., when induced under low oxygen conditions after 3 hours. In one specific embodiment, the bacteria increase the adenosine degradation by about 99% to 99% relative to unmodified bacteria of the same bacterial subtype under the same conditions, i.e., when induced under low oxygen conditions, after 3 hours. In yet another embodiment, the bacteria increase the adenosine degradation by about 100-1000 fold when induced under low oxygen conditions, after 3 hours. In yet another embodiment, the bacteria increase the adenosine degradation by about 1000-10000 fold when induced under low oxygen conditions, after 3 hours.

In one adenosine consumption and arginine production embodiment, the bacteria increase the adenosine degradation by about 95% to 100% relative to unmodified bacteria of the same bacterial subtype under the same conditions, i.e., when induced under low oxygen conditions, after 4 hours. In one embodiment, the bacteria increase the adenosine degradation by about 98% to 100% relative to unmodified bacteria of the same bacterial subtype under the same conditions, i.e., when induced under low oxygen conditions after 4 hours. In one embodiment, the bacteria increase the adenosine degradation by about 99% to 99% relative to unmodified bacteria of the same bacterial subtype under the same conditions, i.e., when induced under low oxygen conditions, after 4 hours. In yet another embodiment, the bacteria increase the adenosine degradation by about 100-1000 fold when induced under low oxygen conditions, after 4 hours. In yet another embodiment, the bacteria increase the adenosine degradation by about 1000-10000 fold when induced under low oxygen conditions, after 4 hours.

In any adenosine consumption and arginine production embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions.

In yet another adenosine consumption and arginine production embodiment, the genetically engineered bacteria produce at least about 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more arginine than unmodified bacteria of the same bacterial subtype under the same conditions.

In any of these adenosine consumption and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more glutamate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more glutamate than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these adenosine consumption and arginine production embodiments, the bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions.

In any of these embodiments, the bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some adenosine consumption and arginine production consumption embodiments, the genetically engineered microorganisms are capable of expressing any one or more of the described circuits for the degradation of adenosine and production of arginine in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding circuitry for the degradation of adenosine and the production of arginine are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In any of these adenosine consumption and arginine production embodiments, any one or more of the described adenosine degradation circuits and arginine production circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the bacteria genetically engineered to consume adenosine and kynurenine may be administered alone or in combination with one or more immune checkpoint inhibitors described herein, including but not limited anti-CTLA4, anti-PD1, or anti-PD-L1 antibodies.

Kynurenine Consumption and Arginine Production

In some embodiments, the genetically engineered bacteria comprise circuitry for the consumption of kynurenine and the production of arginine. In one embodiment, the genetically engineered bacteria comprise gene sequences encoding an arginine production circuit in combination with a kynurenine consumption (and optionally tryptophan production) pathway. In one embodiment, the genetically engineered bacteria comprise gene sequences encoding kynureninase in combination with arginine production pathway. In one embodiment, the kynureninase is from *Pseudomonas fluorescens*. In one specific embodiment, the kynureninase from *Pseudomonas fluorescens* is chromosomally integrated and under control of a constitutive promoter. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR. In any of these embodiments, TrpE may be deleted.

In alternate embodiments, the disclosure provides a composition comprising a combination (e.g., two or more) of different genetically engineered bacteria, each bacteria encoding a different immune modulator. Accordingly, in some embodiments, the composition comprises genetically engineered bacteria comprising circuitry for the consumption of kynurenine and genetically engineered bacteria comprising circuitry for the production of arginine. In one embodiment, the composition comprises genetically engineered bacteria comprising gene sequences encoding an arginine production circuit in combination with genetically engineered bacteria comprising gene sequences encoding a kynurenine consumption (and optionally tryptophan production) pathway. In one embodiment, the composition comprises genetically engineered bacteria comprising gene sequences encoding kynureninase in combination with genetically engineered bacteria comprising gene sequences encoding an arginine production pathway. In one embodiment, the kynureninase is from *Pseudomonas fluorescens*. In one specific embodiment, the kynureninase from *Pseudomonas fluorescens* is chromosomally integrated and under control of a constitutive promoter. In one embodiment, the gene sequences encoding the arginine production circuit comprise feedback resistant ArgA (ArgAfbr) and a deletion in the endogenous arginine operon repressor ArgR. In one embodiment, the ArgAfbr is from *E coli*. In one specific embodiment, ArgAfbr is integrated into the chromosome and is under the control of a low-oxygen promoter, e.g., FNR. In any of these embodiments, TrpE may be deleted.

In any of these kynurenine consumption and arginine production embodiments, the bacteria consume 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more kynurenine than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more kynurenine than unmodified bacteria of the same bacterial subtype under the same conditions. In yet another embodiment, the genetically engineered bacteria consume about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more kynurenine than unmodified bacteria of the same bacterial subtype under the same conditions.

In any of these kynurenine consumption and arginine production embodiments, the bacteria genetically engineered to consume kynurenine and optionally produce tryptophan produce at least about 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more tryptophan than unmodified bacteria of the same bacterial subtype under the same conditions. In yet another embodiment, the genetically engineered bacteria produce at least about 1.0-1.2-fold, 1.2-1.4-fold, 1.4-1.6-fold, 1.6-1.8-fold, 1.8-2-fold, or two-fold more tryptophan than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more tryptophan than unmodified bacteria of the same bacterial subtype under the same conditions.

In any of these kynurenine consumption and arginine production embodiments, the genetically engineered bacteria increase the kynurenine consumption rate by 0% to 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% relative to unmodified bacteria of the same bacterial subtype under the same conditions. In yet another kynurenine consumption and arginine production embodiment, the genetically engineered bacteria increase the kynurenine consumption rate by 1.0-1.2-fold, 1.2-1.4-fold, 1.4-1.6-fold, 1.6-1.8-fold, 1.8-2-fold, or two-fold more relative to unmodified bacteria of the same bacterial subtype under the same conditions. In yet another embodiment, the genetically engineered bacteria increase the kynurenine consumption rate by about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold relative to unmodified bacteria of the same bacterial subtype under the same conditions.

In one kynurenine consumption and arginine production embodiment, the genetically engineered bacteria increase the kynurenine consumption by about 80% to 100% relative to unmodified bacteria of the same bacterial subtype under the same conditions, after 4 hours. In one kynurenine consumption and arginine production embodiment, the genetically engineered bacteria increase the kynurenine consumption by about 90% to 100% relative to unmodified bacteria of the same bacterial subtype under the same conditions after 4 hours. In one specific kynurenine consumption and arginine production embodiment, the genetically engineered bacteria increase the kynurenine consumption by about 95% to 100% relative to unmodified bacteria of the same bacterial subtype under the same conditions, after 4 hours. In one specific embodiment, the genetically engineered bacteria increase the kynurenine consumption by about 99% to 100% relative to unmodified bacteria of the same bacterial subtype under the same conditions, after 4 hours. In yet another embodiment, the genetically engineered bacteria increase the kynurenine consumption by about 10-50 fold after 4 hours. In yet another embodiment, the genetically engineered bacteria increase the kynurenine consumption by about 50-100 fold after 4 hours. In yet another embodiment, the genetically engineered bacteria increase the kynurenine consumption by about 100-500 fold after 4 hours. In yet another embodiment, the genetically engineered bacteria increase the kynurenine consumption by about 500-1000 fold after 4 hours. In yet another embodiment, the genetically engineered bacteria increase the kynurenine consumption by about 1000-5000 fold after 4 hours. In yet another embodiment, the genetically engineered bacteria increase the kynurenine consumption by about 5000-10000 fold after 4 hours. In yet another embodiment, the genetically engineered bacteria increase the kynurenine consumption by about 10000-1000 fold after 4 hours.

In any kynurenine consumption and arginine production embodiments, the genetically engineered bacteria produce at least about 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more arginine than unmodified bacteria of the same bacterial subtype under the same conditions.

In yet another kynurenine consumption and arginine production embodiment, the genetically engineered bacteria produce at least about 1.0-1.2-fold, 1.2-1.4-fold, 1.4-1.6-fold, 1.6-1.8-fold, 1.8-2-fold, or two-fold more arginine than unmodified bacteria of the same bacterial subtype under the same conditions. In yet another embodiment, the genetically engineered bacteria produce about three-fold, four-fold, five-fold, six-fold, seven-fold, eight-fold, nine-fold, ten-fold, fifteen-fold, twenty-fold, thirty-fold, forty-fold, or fifty-fold, hundred-fold, five hundred-fold, or one-thousand-fold more arginine than unmodified bacteria of the same bacterial subtype under the same conditions.

In any of these kynurenine consumption and arginine production embodiments, the genetically engineered bacteria consume 0% to 2%, 2% to 4%, 4% to 6%, 6% to 8%, 8% to 10%, 10% to 12%, 12% to 14%, 14% to 16%, 16% to 18%, 18% to 20%, 20% to 25%, 25% to 30%, 30% to 35%, 35% to 40%, 40% to 45% 45% to 50%, 50% to 55%, 55% to 60%, 60% to 65%, 65% to 70% to 80%, 80% to 90%, or 90% to 100% more glutamate than unmodified bacteria of the same bacterial subtype under the same conditions. In yet another embodiment, the genetically engineered bacteria consume 1.0-1.2-fold, 1.2-1.4-fold, 1.4-1.6-fold, 1.6-1.8-fold, 1.8-2-fold, or two-fold more glutamate than unmodified bacteria of the same bacterial subtype under the same conditions. In yet another embodiment, the genetically engineered bacteria consume about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more glutamate than unmodified bacteria of the same bacterial subtype under the same conditions.

In any of these kynurenine consumption and arginine production embodiments, the bacteria are capable of reducing cell proliferation by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor growth by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor size by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor volume by at least about 10%, 20%, 25%, 30%, 40%, 50%, 60%, 70%, 75%, 80%, 85%, 90%, 95%, or more as compared to an unmodified bacteria of the same subtype under the same conditions. In any of these embodiments, the bacteria are capable of reducing tumor weight by at least about 10%, 20%, 25%, 30%, 40%, 50%, 60%, 70%, 75%, 80%, 85%, 90%, 95%, or more as compared to an unmodified bacteria of the same subtype under the same conditions.

In some kynurenine consumption and arginine production embodiments, the genetically engineered microorganisms are capable of expressing any one or more of the described circuits for the kynurenine consumption and arginine production in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) encoding circuitry for kynurenine consumption and arginine production are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In any of these kynurenine consumption and arginine production embodiments, any one or more of the described adenosine degradation circuits and kynurenine consumption circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the bacteria genetically engineered to consume adenosine and kynurenine may be administered alone or in combination with one or more immune checkpoint inhibitors described herein, including but not limited anti-CTLA4, anti-PD1, or anti-PD-L1 antibodies.

Regulating Expression of Anti-Cancer Molecules

In some embodiments, the bacterial cell comprises a stably maintained plasmid or chromosome carrying the gene(s) encoding payload (s), such that the payload(s) can be expressed in the host cell, and the host cell is capable of survival and/or growth in vitro, e.g., in medium, and/or in vivo, e.g., in the gut or in the tumor microenvironment. In some embodiments, bacterial cell comprises two or more distinct payloads or operons, e.g., two or more payload genes. In some embodiments, bacterial cell comprises three or more distinct transporters or operons, e.g., three or more payload genes. In some embodiments, bacterial cell comprises 4, 5, 6, 7, 8, 9, 10, or more distinct payloads or operons, e.g., 4, 5, 6, 7, 8, 9, 10, or more payload genes.

Herein the terms "payload" "polypeptide of interest" or "polypeptides of interest", "protein of interest", "proteins of interest", "payloads" "effector molecule", "effector" refers to one or more effector molecules described herein and/or one or more enzyme(s) or polypeptide(s) function as enzymes needed for the production of such effector molecules. Non-limiting examples of payloads include IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, antibodies, e.g., scFvs, including but not limited to checkpoint inhibitors (e.g., PD1, PDL1, CTLA4, anti-LAGS, anti-TIM3 and others described herein), kynureninase, tryptophan and/or arginine production enzymes, adenosine degradation enzymes.

As used herein, the term "polypeptide of interest" or "polypeptides of interest", "protein of interest", "proteins of interest", "payload", "payloads" further includes any or a plurality of any of the tryptophan synthesis enzymes, kynurenine degrading enzymes, adenosine degrading enzymes, arginine producing enzymes, and other metabolic pathway enzymes described herein. As used herein, the term "gene of interest" or "gene sequence of interest" includes any or a plurality of any of the gene(s) an/or gene sequence(s) and or gene cassette(s) encoding one or more anti-cancer molecule(s) described herein.

In some embodiments, the genetically engineered bacteria comprise multiple copies of the same payload gene(s). In some embodiments, the gene encoding the payload is present on a plasmid and operably linked to a directly or indirectly inducible promoter. In some embodiments, the gene encoding the payload is present on a plasmid and operably linked to a constitutive promoter. In some embodiments, the gene encoding the payload is present on a plasmid and operably linked to a promoter that is induced under low-oxygen or anaerobic conditions. In some embodiments, the gene encoding the payload is present on plasmid and operably linked to a promoter that is induced by exposure to tetracycline or arabinose, or another chemical or nutritional inducer described herein.

In some embodiments, the gene encoding the payload is present on a chromosome and operably linked to a directly or indirectly inducible promoter. In some embodiments, the gene encoding the payload is present on a chromosome and operably linked to a constitutive promoter. In some embodiments, the gene encoding the payload is present in the chromosome and operably linked to a promoter that is induced under low-oxygen or anaerobic conditions. In some embodiments, the gene encoding the payload is present on chromosome and operably linked to a promoter that is induced by exposure to tetracycline or arabinose, or another chemical or nutritional inducer described herein.

In some embodiments, the genetically engineered bacteria comprise two or more payloads, all of which are present on the chromosome. In some embodiments, the genetically engineered bacteria comprise two or more payloads, all of which are present on one or more same or different plasmids. In some embodiments, the genetically engineered bacteria comprise two or more payloads, some of which are present on the chromosome and some of which are present on one or more same or different plasmids.

In any of the embodiments described above, the one or more payload(s) for producing the anti-cancer molecule combinations are operably linked to one or more directly or indirectly inducible promoter(s). In some embodiments, the one or more payload(s) are operably linked to a directly or indirectly inducible promoter that is induced under exogeneous environmental conditions, e.g., conditions found in the gut, the tumor microenvironment or other tissue specific conditions. In some embodiments, the one or more payload(s) are operably linked to a directly or indirectly inducible promoter that is induced by metabolites found in the gut, the tumor microenvironment or other specific conditions. In some embodiments, the one or more payload(s) are operably linked to a directly or indirectly inducible promoter that is induced under low-oxygen or anaerobic conditions. In some embodiments, the one or more payload(s) are operably linked to a directly or indirectly inducible promoter that is induced under inflammatory conditions (e.g., RNS, ROS), as described herein. In some embodiments, the one or more payload(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter.

In some embodiments, the promoter is induced under in vivo conditions, e.g., the gut, as described herein. In some embodiments, the promoters is induced under in vitro conditions, e.g., various cell culture and/or cell manufacturing conditions, as described herein. In some embodiments, the promoter is induced under in vivo conditions, e.g., the gut, as described herein, and under in vitro conditions, e.g., various cell culture and/or cell production and/or manufacturing conditions, as described herein.

In some embodiments, the promoter that is operably linked to the gene encoding the payload is directly induced by exogenous environmental conditions (e.g., in vivo and/or in vitro and/or production/manufacturing conditions). In some embodiments, the promoter that is operably linked to the gene encoding the payload is indirectly induced by exogenous environmental conditions (e.g., in vivo and/or in vitro and/or production/manufacturing conditions).

In some embodiments, the promoter is directly or indirectly induced by exogenous environmental conditions specific to the gut of a mammal. In some embodiments, the promoter is directly or indirectly induced by exogenous environmental conditions specific to the hypoxic environment of a tumor and/or the small intestine of a mammal. In some embodiments, the promoter is directly or indirectly induced by low-oxygen or anaerobic conditions such as the hypoxic environment of a tumor and/or the environment of the mammalian gut. In some embodiments, the promoter is directly or indirectly induced by molecules or metabolites that are specific to the tumor, a particular tissue or the gut of a mammal. In some embodiments, the promoter is directly or indirectly induced by a molecule that is co-administered with the bacterial cell.

FNR Dependent Regulation

The genetically engineered bacteria of the invention comprise a gene or gene cassette for producing anti-cancer molecule, wherein the gene or gene cassette is operably linked to a directly or indirectly inducible promoter that is controlled by exogenous environmental condition(s). In some embodiments, the inducible promoter is an oxygen level-dependent promoter and anti-cancer molecule is expressed in low-oxygen, microaerobic, or anaerobic conditions. For example, in low oxygen conditions, the oxygen level-dependent promoter is activated by a corresponding oxygen level-sensing transcription factor, thereby driving production of anti-cancer molecule.

Bacteria have evolved transcription factors that are capable of sensing oxygen levels. Different signaling pathways may be triggered by different oxygen levels and occur with different kinetics. An oxygen level-dependent promoter is a nucleic acid sequence to which one or more oxygen level-sensing transcription factors is capable of binding, wherein the binding and/or activation of the corresponding transcription factor activates downstream gene expression. In one embodiment, the genetically engineered bacteria comprise a gene or gene cassette for producing a payload under the control of an oxygen level-dependent promoter. In a more specific aspect, the genetically engineered bacteria comprise a gene or gene cassette for producing a payload under the control of an oxygen level-dependent promoter that is activated under low-oxygen or anaerobic environments, such as the hypoxic environment of a tumor and/or the environment of the mammalian gut.

In certain embodiments, the bacterial cell comprises a gene encoding a payload expressed under the control of a fumarate and nitrate reductase regulator (FNR) responsive promoter. In *E. coli*, FNR is a major transcriptional activator that controls the switch from aerobic to anaerobic metabolism (Unden et al., 1997). In the anaerobic state, FNR dimerizes into an active DNA binding protein that activates hundreds of genes responsible for adapting to anaerobic growth. In the aerobic state, FNR is prevented from dimerizing by oxygen and is inactive. FNR responsive promoters include, but are not limited to, the FNR responsive promoters of SEQ ID NO: 563-579. Underlined sequences are predicted ribosome binding sites, and bolded sequences are restriction sites used for cloning.

FNR promoter sequences are known in the art, and any suitable FNR promoter sequence(s) may be used in the genetically engineered bacteria of the invention. Any suitable FNR promoter(s) may be combined with any suitable payload.

As used herein the term "payload" refers to one or more e.g. anti-cancer molecule(s), including but not limited to, IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, hyaluronidase, antibodies, e.g., scFvs, including but not limited to checkpoint inhibitors (e.g., PD1, PDL1, CTLA4, anti-LAG3, anti-TIM3 and others described herein), kynureninase, tryptophan and/or arginine production enzymes, adenosine degradation enzymes.

Non-limiting FNR promoter sequences are provided in SEQ ID NO: 563-579. In some embodiments, the genetically engineered bacteria of the invention comprise one or more of: SEQ ID NO: 563, SEQ ID NO: 564, SEQ ID NO: 565, SEQ ID NO: 566, SEQ ID NO: 567, SEQ ID NO: 568, SEQ ID NO: 569, nirB1 promoter (SEQ ID NO: 570), nirB2 promoter (SEQ ID NO: 571), nirB3 promoter (SEQ ID NO: 572), ydfZ promoter (SEQ ID NO: 573), nirB promoter fused to a strong ribosome binding site (SEQ ID NO: 574), ydfZ promoter fused to a strong ribosome binding site (SEQ ID NO: 575), fnrS, an anaerobically induced small RNA gene (fnrS1 promoter SEQ ID NO: 576 or fnrS2 promoter SEQ ID NO: 577), nirB promoter fused to a crp binding site (SEQ ID NO: 578), and fnrS fused to a crp binding site (SEQ ID NO: 579). In some embodiments, the FNR-responsive promoter is at least about 80%, at least about 85%, at least about 90%, at least about 95%, or at least about 99% homologous to a sequence selected from SEQ ID NOs: 563-579. In another embodiment, the genetically engineered bacteria comprise a gene sequence comprising an FNR-responsive promoter comprising a sequence selected from SEQ ID NOs: 563-579. In yet another embodiment, the FNR-responsive promoter consists of a sequence selected from SEQ ID NOs: 563-579.

In some embodiments, multiple distinct FNR nucleic acid sequences are inserted in the genetically engineered bacteria. In alternate embodiments, the genetically engineered bacteria comprise a gene encoding a payload expressed under the control of an alternate oxygen level-dependent promoter, e.g., DNR (Trunk et al., 2010) or ANR (Ray et al., 1997). In these embodiments, expression of the payload gene is particularly activated in a low-oxygen or anaerobic environment, such as in the gut. In some embodiments, gene expression is further optimized by methods known in the art, e.g., by optimizing ribosomal binding sites and/or increasing mRNA stability. In one embodiment, the mammalian gut is a human mammalian gut.

In another embodiment, the genetically engineered bacteria comprise the gene or gene cassette for producing anti-cancer molecule expressed under the control of anaerobic regulation of arginine deiminase and nitrate reduction transcriptional regulator (ANR). In *P. aeruginosa*, ANR is "required for the expression of physiological functions which are inducible under oxygen-limiting or anaerobic conditions" (Winteler et al., 1996; Sawers 1991). *P. aeruginosa* ANR is homologous with *E. coli* FNR, and "the consensus FNR site (TTGAT----ATCAA) was recognized efficiently by ANR and FNR" (Winteler et al., 1996). Like FNR, in the anaerobic state, ANR activates numerous genes responsible for adapting to anaerobic growth. In the aerobic state, ANR is inactive. *Pseudomonas fluorescens, Pseudomonas putida, Pseudomonas syringae,* and *Pseudomonas mendocina* all have functional analogs of ANR (Zimmermann et al., 1991). Promoters that are regulated by ANR are known in the art, e.g., the promoter of the arcDABC operon (see, e.g., Hasegawa et al., 1998).

In other embodiments, the one or more gene sequence(s) for producing a payload are expressed under the control of an oxygen level-dependent promoter fused to a binding site for a transcriptional activator, e.g., CRP. CRP (cyclic AMP receptor protein or catabolite activator protein or CAP) plays a major regulatory role in bacteria by repressing genes responsible for the uptake, metabolism, and assimilation of less favorable carbon sources when rapidly metabolizable carbohydrates, such as glucose, are present (Wu et al., 2015). This preference for glucose has been termed glucose repression, as well as carbon catabolite repression (Deutscher, 2008; Görke and Stülke, 2008). In some embodiments, the gene or gene cassette for producing an anti-cancer molecule is controlled by an oxygen level-dependent promoter fused to a CRP binding site. In some embodiments, the one or more gene sequence(s) for a payload are controlled by a FNR promoter fused to a CRP binding site. In these embodiments, cyclic AMP binds to CRP when no glucose is present in the environment. This binding causes a conformational change in CRP, and allows CRP to bind tightly to its binding site. CRP binding then activates transcription of the gene or gene cassette by recruiting RNA polymerase to the FNR promoter via direct protein-protein interactions. In the presence of glucose, cyclic AMP does not bind to CRP and transcription of the gene or gene cassette for producing a payload is repressed. In some embodiments, an oxygen level-dependent promoter (e.g., an FNR promoter) fused to a binding site for a transcriptional activator is used to ensure that the gene or gene cassette for producing a payload is not expressed under anaerobic conditions when sufficient amounts of glucose are present, e.g., by adding glucose to growth media in vitro.

In some embodiments, the genetically engineered bacteria comprise an oxygen level-dependent promoter from a different species, strain, or substrain of bacteria. In some embodiments, the genetically engineered bacteria comprise an oxygen level-sensing transcription factor, e.g., FNR, ANR or DNR, from a different species, strain, or substrain of bacteria. In some embodiments, the genetically engineered bacteria comprise an oxygen level-sensing transcription factor and corresponding promoter from a different species, strain, or substrain of bacteria. The heterologous oxygen-level dependent transcriptional regulator and/or promoter increases the transcription of genes operably linked to said promoter, e.g., one or more gene sequence(s) for producing the payload(s) in a low-oxygen or anaerobic environment, as compared to the native gene(s) and promoter in the bacteria under the same conditions. In certain embodiments, the non-native oxygen-level dependent transcriptional regulator is an FNR protein from *N. gonorrhoeae* (see, e.g., Isabella et al., 2011). In some embodiments, the corresponding wild-type transcriptional regulator is left intact and retains wild-type activity. In alternate embodiments, the corresponding wild-type transcriptional regulator is deleted or mutated to reduce or eliminate wild-type activity.

In some embodiments, the genetically engineered bacteria comprise a wild-type oxygen-level dependent transcriptional regulator, e.g., FNR, ANR, or DNR, and corresponding promoter that is mutated relative to the wild-type promoter from bacteria of the same subtype. The mutated promoter enhances binding to the wild-type transcriptional regulator and increases the transcription of genes operably linked to said promoter, e.g., the gene encoding the payload, in a low-oxygen or anaerobic environment, as compared to the wild-type promoter under the same conditions. In some embodiments, the genetically engineered bacteria comprise a wild-type oxygen-level dependent promoter, e.g., FNR, ANR, or DNR promoter, and corresponding transcriptional regulator that is mutated relative to the wild-type transcriptional regulator from bacteria of the same subtype. The mutated transcriptional regulator enhances binding to the wild-type promoter and increases the transcription of genes operably linked to said promoter, e.g., the gene encoding the payload, in a low-oxygen or anaerobic environment, as compared to the wild-type transcriptional regulator under the same conditions. In certain embodiments, the mutant oxygen-level dependent transcriptional regulator is an FNR protein comprising amino acid substitutions that enhance dimerization and FNR activity (see, e.g., Moore et al., (2006). In some embodiments, both the oxygen level-sensing transcriptional regulator and corresponding promoter are mutated relative to the wild-type sequences from bacteria of the same subtype in order to increase expression of the payload in low-oxygen conditions.

In some embodiments, the bacterial cells comprise multiple copies of the endogenous gene encoding the oxygen level-sensing transcriptional regulator, e.g., the FNR gene. In some embodiments, the gene encoding the oxygen level-sensing transcriptional regulator is present on a plasmid. In some embodiments, the gene encoding the oxygen level-sensing transcriptional regulator and the gene encoding the payload are present on different plasmids. In some embodiments, the gene encoding the oxygen level-sensing transcriptional regulator and the gene encoding the payload are present on the same plasmid.

In some embodiments, the gene encoding the oxygen level-sensing transcriptional regulator is present on a chromosome. In some embodiments, the gene encoding the oxygen level-sensing transcriptional regulator and the gene encoding the payload are present on different chromosomes. In some embodiments, the gene encoding the oxygen level-sensing transcriptional regulator and the gene encoding the payload are present on the same chromosome. In some instances, it may be advantageous to express the oxygen level-sensing transcriptional regulator under the control of an inducible promoter in order to enhance expression stability. In some embodiments, expression of the transcriptional regulator is controlled by a different promoter than the promoter that controls expression of the gene encoding the payload. In some embodiments, expression of the transcriptional regulator is controlled by the same promoter that controls expression of the payload. In some embodiments, the transcriptional regulator and the payload are divergently transcribed from a promoter region.

RNS-Dependent Regulation

In some embodiments, the genetically engineered bacteria or genetically engineered virus comprise a gene encoding a payload that is expressed under the control of an inducible promoter. In some embodiments, the genetically engineered bacterium or genetically engineered virus that expresses a payload under the control of a promoter that is activated by inflammatory conditions. In one embodiment, the gene for producing the payload is expressed under the control of an inflammatory-dependent promoter that is activated in inflammatory environments, e.g., a reactive nitrogen species or RNS promoter.

As used herein, "reactive nitrogen species" and "RNS" are used interchangeably to refer to highly active molecules, ions, and/or radicals derived from molecular nitrogen. RNS can cause deleterious cellular effects such as nitrosative stress. RNS includes, but is not limited to, nitric oxide (NO.), peroxynitrite or peroxynitrite anion (ONOO—), nitrogen dioxide (.NO2), dinitrogen trioxide (N2O3), peroxynitrous acid (ONOOH), and nitroperoxycarbonate (ONOOCO2-) (unpaired electrons denoted by .). Bacteria have evolved transcription factors that are capable of sensing RNS levels. Different RNS signaling pathways are triggered by different RNS levels and occur with different kinetics.

As used herein, "RNS-inducible regulatory region" refers to a nucleic acid sequence to which one or more RNS-sensing transcription factors is capable of binding, wherein the binding and/or activation of the corresponding transcription factor activates downstream gene expression; in the presence of RNS, the transcription factor binds to and/or activates the regulatory region. In some embodiments, the RNS-inducible regulatory region comprises a promoter sequence. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; in the presence of RNS, the transcription factor undergoes a conformational change, thereby activating downstream gene expression. The RNS-inducible regulatory region may be operatively linked to a gene or genes, e.g., a payload gene sequence(s), e.g., any of the payloads described herein. For example, in the presence of RNS, a transcription factor senses RNS and activates a corresponding RNS-inducible regulatory region, thereby driving expression of an operatively linked gene sequence. Thus, RNS induces expression of the gene or gene sequences.

As used herein, "RNS-derepressible regulatory region" refers to a nucleic acid sequence to which one or more RNS-sensing transcription factors is capable of binding, wherein the binding of the corresponding transcription factor represses downstream gene expression; in the presence of RNS, the transcription factor does not bind to and does not repress the regulatory region. In some embodiments, the RNS-derepressible regulatory region comprises a promoter sequence. The RNS-derepressible regulatory region may be operatively linked to a gene or genes, e.g., a payload gene sequence(s). For example, in the presence of RNS, a transcription factor senses RNS and no longer binds to and/or represses the regulatory region, thereby derepressing an operatively linked gene sequence or gene cassette. Thus, RNS derepresses expression of the gene or genes.

As used herein, "RNS-repressible regulatory region" refers to a nucleic acid sequence to which one or more RNS-sensing transcription factors is capable of binding, wherein the binding of the corresponding transcription factor represses downstream gene expression; in the presence of RNS, the transcription factor binds to and represses the regulatory region. In some embodiments, the RNS-repressible regulatory region comprises a promoter sequence. In some embodiments, the transcription factor that senses RNS is capable of binding to a regulatory region that overlaps with part of the promoter sequence. In alternate embodiments, the transcription factor that senses RNS is capable of binding to a regulatory region that is upstream or downstream of the promoter sequence. The RNS-repressible regulatory region may be operatively linked to a gene sequence or gene cassette. For example, in the presence of RNS, a transcription factor senses RNS and binds to a corresponding RNS-repressible regulatory region, thereby blocking expression of an operatively linked gene sequence or gene sequences. Thus, RNS represses expression of the gene or gene sequences.

As used herein, a "RNS-responsive regulatory region" refers to a RNS-inducible regulatory region, a RNS-repressible regulatory region, and/or a RNS-derepressible regulatory region. In some embodiments, the RNS-responsive regulatory region comprises a promoter sequence. Each regulatory region is capable of binding at least one corresponding RNS-sensing transcription factor. Examples of transcription factors that sense RNS and their corresponding RNS-responsive genes, promoters, and/or regulatory regions include, but are not limited to, those shown in Table 9.

TABLE 9

Examples of RNS-sensing transcription factors and RNS-responsive genes

| RNS-sensing transcription factor: | Primarily capable of sensing: | Examples of responsive genes, promoters, and/or regulatory regions: |
|---|---|---|
| NsrR | NO | norB, aniA, nsrR, hmpA, ytfE, ygbA, hcp, hcr, nrfA, aox |
| NorR | NO | norVW, nor |
| DNR | NO | norCB, nir, nor, nos |

In some embodiments, the genetically engineered bacteria of the invention comprise a tunable regulatory region that is directly or indirectly controlled by a transcription factor that is capable of sensing at least one reactive nitrogen species. The tunable regulatory region is operatively linked to a gene or genes capable of directly or indirectly driving the expression of a payload, thus controlling expression of the payload relative to RNS levels. For example, the tunable regulatory region is a RNS-inducible regulatory region, and the payload is a payload, such as any of the payloads provided herein; when RNS is present, e.g., in an inflamed tissue, a RNS-sensing transcription factor binds to and/or activates the regulatory region and drives expression of the payload gene or genes. Subsequently, when inflammation is ameliorated, RNS levels are reduced, and production of the payload is decreased or eliminated.

In some embodiments, the tunable regulatory region is a RNS-inducible regulatory region; in the presence of RNS, a transcription factor senses RNS and activates the RNS-inducible regulatory region, thereby driving expression of an operatively linked gene or genes. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; when the transcription factor senses RNS, it undergoes a conformational change, thereby inducing downstream gene expression.

In some embodiments, the tunable regulatory region is a RNS-inducible regulatory region, and the transcription factor that senses RNS is NorR. NorR "is an NO-responsive transcriptional activator that regulates expression of the norVW genes encoding flavorubredoxin and an associated flavoprotein, which reduce NO to nitrous oxide" (Spiro 2006). The genetically engineered bacteria of the invention may comprise any suitable RNS-responsive regulatory region from a gene that is activated by NorR. Genes that are capable of being activated by NorR are known in the art (see, e.g., Spiro 2006; Vine et al., 2011; Karlinsey et al., 2012). In certain embodiments, the genetically engineered bacteria of the invention comprise a RNS-inducible regulatory region from norVW that is operatively linked to a gene or genes, e.g., one or more payload gene sequence(s). In the presence of RNS, a NorR transcription factor senses RNS and activates to the norVW regulatory region, thereby driving expression of the operatively linked gene(s) and producing the payload(s).

In some embodiments, the tunable regulatory region is a RNS-inducible regulatory region, and the transcription factor that senses RNS is DNR. DNR (dissimilatory nitrate respiration regulator) "promotes the expression of the nir, the nor and the nos genes" in the presence of nitric oxide (Castiglione et al., 2009). The genetically engineered bacteria of the invention may comprise any suitable RNS-responsive regulatory region from a gene that is activated by DNR. Genes that are capable of being activated by DNR are known in the art (see, e.g., Castiglione et al., 2009; Giardina et al., 2008). In certain embodiments, the genetically engineered bacteria of the invention comprise a RNS-inducible regulatory region from norCB that is operatively linked to a gene or gene cassette, e.g., a butyrogenic gene cassette. In the presence of RNS, a DNR transcription factor senses RNS and activates to the norCB regulatory region, thereby driving expression of the operatively linked gene or genes and producing one or more payloads. In some embodiments, the DNR is *Pseudomonas aeruginosa* DNR.

In another embodiment, the genetically engineered bacteria comprise the gene or gene cassette for producing anti-cancer molecule expressed under the control of the dissimilatory nitrate respiration regulator (DNR). DNR is a member of the FNR family (Arai et al., 1995) and is a transcriptional regulator that is required in conjunction with ANR for "anaerobic nitrate respiration of *Pseudomonas aeruginosa*" (Hasegawa et al., 1998). For certain genes, the FNR-binding motifs "are probably recognized only by DNR" (Hasegawa et al., 1998). Any suitable transcriptional regulator that is controlled by exogenous environmental conditions and corresponding regulatory region may be used. Non-limiting examples include ArcA/B, ResD/E, NreA/B/C, and AirSR, and others are known in the art.

In some embodiments, the tunable regulatory region is a RNS-derepressible regulatory region, and binding of a corresponding transcription factor represses downstream gene expression; in the presence of RNS, the transcription factor no longer binds to the regulatory region, thereby derepressing the operatively linked gene or gene cassette.

In some embodiments, the tunable regulatory region is a RNS-derepressible regulatory region, and the transcription factor that senses RNS is NsrR. NsrR is "an Rrf2-type transcriptional repressor [that] can sense NO and control the expression of genes responsible for NO metabolism" (Isabella et al., 2009). The genetically engineered bacteria of the invention may comprise any suitable RNS-responsive regulatory region from a gene that is repressed by NsrR. In some embodiments, the NsrR is *Neisseria gonorrhoeae* NsrR. Genes that are capable of being repressed by NsrR are known in the art (see, e.g., Isabella et al., 2009; Dunn et al., 2010). In certain embodiments, the genetically engineered bacteria of the invention comprise a RNS-derepressible regulatory region from norB that is operatively linked to a gene or genes, e.g., a payload gene or genes. In the presence of RNS, an NsrR transcription factor senses RNS and no longer binds to the norB regulatory region, thereby derepressing the operatively linked a payload gene or genes and producing the encoding a payload(s).

In some embodiments, it is advantageous for the genetically engineered bacteria to express a RNS-sensing transcription factor that does not regulate the expression of a significant number of native genes in the bacteria. In some embodiments, the genetically engineered bacterium of the invention expresses a RNS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the RNS-sensing transcription factor is NsrR, e.g., from is *Neisseria gonorrhoeae*, wherein the *Escherichia coli* does not comprise binding sites for said NsrR. In some embodiments, the heterologous transcription factor minimizes or eliminates off-target effects on endogenous regulatory regions and genes in the genetically engineered bacteria.

In some embodiments, the tunable regulatory region is a RNS-repressible regulatory region, and binding of a corresponding transcription factor represses downstream gene expression; in the presence of RNS, the transcription factor senses RNS and binds to the RNS-repressible regulatory region, thereby repressing expression of the operatively linked gene or gene cassette. In some embodiments, the RNS-sensing transcription factor is capable of binding to a regulatory region that overlaps with part of the promoter sequence. In alternate embodiments, the RNS-sensing transcription factor is capable of binding to a regulatory region that is upstream or downstream of the promoter sequence.

In these embodiments, the genetically engineered bacteria may comprise a two repressor activation regulatory circuit, which is used to express a payload. The two repressor activation regulatory circuit comprises a first RNS-sensing repressor and a second repressor, which is operatively linked to a gene or gene cassette, e.g., encoding a payload. In one aspect of these embodiments, the RNS-sensing repressor inhibits transcription of the second repressor, which inhibits the transcription of the gene or gene cassette. Examples of second repressors useful in these embodiments, include, but are not limited to, TetR, C1, and LexA. In the absence of binding by the first repressor (which occurs in the absence of RNS), the second repressor is transcribed, which represses expression of the gene or genes. In the presence of binding by the first repressor (which occurs in the presence of RNS), expression of the second repressor is repressed, and the gene or genes, e.g., a payload gene or genes is expressed.

A RNS-responsive transcription factor may induce, derepress, or repress gene expression depending upon the regulatory region sequence used in the genetically engineered bacteria. One or more types of RNS-sensing transcription factors and corresponding regulatory region sequences may be present in genetically engineered bacteria. In some embodiments, the genetically engineered bacteria comprise one type of RNS-sensing transcription factor, e.g., NsrR, and one corresponding regulatory region sequence, e.g., from norB. In some embodiments, the genetically engineered bacteria comprise one type of RNS-sensing transcription factor, e.g., NsrR, and two or more different corresponding regulatory region sequences, e.g., from norB and aniA. In some embodiments, the genetically engineered bacteria comprise two or more types of RNS-sensing transcription factors, e.g., NsrR and NorR, and two or more corresponding regulatory region sequences, e.g., from norB and norR, respectively. One RNS-responsive regulatory region may be capable of binding more than one transcription factor. In some embodiments, the genetically engineered bacteria comprise two or more types of RNS-sensing transcription factors and one corresponding regulatory region sequence. Nucleic acid sequences of several RNS-regulated regulatory regions are known in the art (see, e.g., Spiro 2006; Isabella et al., 2009; Dunn et al., 2010; Vine et al., 2011; Karlinsey et al., 2012).

In some embodiments, the genetically engineered bacteria of the invention comprise a gene encoding a RNS-sensing transcription factor, e.g., the nsrR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the RNS-sensing transcription factor under the control of an inducible promoter in order to enhance expression stability. In some embodiments, expression of the RNS-sensing transcription factor is controlled by a different promoter than the promoter that controls expression of the therapeutic molecule. In some embodiments, expression of the RNS-sensing transcription factor is controlled by the same promoter that controls expression of the therapeutic molecule. In some embodiments, the RNS-sensing transcription factor and therapeutic molecule are divergently transcribed from a promoter region.

In some embodiments, the genetically engineered bacteria of the invention comprise a gene for a RNS-sensing transcription factor from a different species, strain, or substrain of bacteria. In some embodiments, the genetically engineered bacteria comprise a RNS-responsive regulatory region from a different species, strain, or substrain of bacteria. In some embodiments, the genetically engineered bacteria comprise a RNS-sensing transcription factor and corresponding RNS-responsive regulatory region from a different species, strain, or substrain of bacteria. The heterologous RNS-sensing transcription factor and regulatory region may increase the transcription of genes operatively linked to said regulatory region in the presence of RNS, as compared to the native transcription factor and regulatory region from bacteria of the same subtype under the same conditions.

In some embodiments, the genetically engineered bacteria comprise a RNS-sensing transcription factor, NsrR, and corresponding regulatory region, nsrR, from *Neisseria gonorrhoeae*. In some embodiments, the native RNS-sensing transcription factor, e.g., NsrR, is left intact and retains wild-type activity. In alternate embodiments, the native RNS-sensing transcription factor, e.g., NsrR, is deleted or mutated to reduce or eliminate wild-type activity.

In some embodiments, the genetically engineered bacteria of the invention comprise multiple copies of the endogenous gene encoding the RNS-sensing transcription factor, e.g., the nsrR gene. In some embodiments, the gene encoding the RNS-sensing transcription factor is present on a plasmid. In some embodiments, the gene encoding the RNS-sensing transcription factor and the gene or gene cassette for producing the therapeutic molecule are present on different plasmids. In some embodiments, the gene encoding the RNS-sensing transcription factor and the gene or gene cassette for producing the therapeutic molecule are present on the same plasmid. In some embodiments, the gene encoding the RNS-sensing transcription factor is present on a chromosome. In some embodiments, the gene encoding the RNS-sensing transcription factor and the gene or gene cassette for producing the therapeutic molecule are present on different chromosomes. In some embodiments, the gene encoding the RNS-sensing transcription factor and the gene or gene cassette for producing the therapeutic molecule are present on the same chromosome.

In some embodiments, the genetically engineered bacteria comprise a wild-type gene encoding a RNS-sensing transcription factor, e.g., the NsrR gene, and a corresponding regulatory region, e.g., a norB regulatory region, that is mutated relative to the wild-type regulatory region from bacteria of the same subtype. The mutated regulatory region increases the expression of the payload in the presence of RNS, as compared to the wild-type regulatory region under the same conditions. In some embodiments, the genetically engineered bacteria comprise a wild-type RNS-responsive regulatory region, e.g., the norB regulatory region, and a corresponding transcription factor, e.g., NsrR, that is mutated relative to the wild-type transcription factor from bacteria of the same subtype. The mutant transcription factor increases the expression of the payload in the presence of RNS, as compared to the wild-type transcription factor under the same conditions. In some embodiments, both the RNS-sensing transcription factor and corresponding regulatory region are mutated relative to the wild-type sequences from bacteria of the same subtype in order to increase expression of the payload in the presence of RNS.

In some embodiments, the gene or gene cassette for producing the anti-cancer molecule is present on a plasmid and operably linked to a promoter that is induced by RNS. In some embodiments, expression is further optimized by methods known in the art, e.g., by optimizing ribosomal binding sites, manipulating transcriptional regulators, and/or increasing mRNA stability.

In some embodiments, any of the gene(s) of the present disclosure may be integrated into the bacterial chromosome at one or more integration sites. For example, one or more copies of one or more encoding a payload gene(s) may be integrated into the bacterial chromosome. Having multiple copies of the gene or gen(s) integrated into the chromosome allows for greater production of the payload(s) and also permits fine-tuning of the level of expression. Alternatively, different circuits described herein, such as any of the secretion or exporter circuits, in addition to the therapeutic gene(s) or gene cassette(s) could be integrated into the bacterial chromosome at one or more different integration sites to perform multiple different functions.

In some embodiments, the genetically engineered bacteria of the invention produce at least one payload in the presence of RNS to reduce local gut inflammation by at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold as compared to unmodified bacteria of the same subtype under the same conditions Inflammation may be measured by methods known in the art, e.g., counting disease lesions using endoscopy; detecting T regulatory cell differentiation in peripheral blood, e.g., by fluorescence activated sorting; measuring T regulatory cell levels; measuring cytokine levels; measuring areas of mucosal damage; assaying inflammatory biomarkers, e.g., by qPCR; PCR arrays; transcription factor phosphorylation assays; immunoassays; and/or cytokine assay kits (Mesoscale, Cayman Chemical, Qiagen).

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of payload in the presence of RNS than unmodified bacteria of the same subtype under the same conditions. Certain unmodified bacteria will not have detectable levels of the payload. In embodiments using genetically modified forms of these bacteria, payload will be detectable in the presence of RNS.

ROS-Dependent Regulation

In some embodiments, the genetically engineered bacteria or genetically engineered virus comprise a gene for producing a payload that is expressed under the control of an inducible promoter. In some embodiments, the genetically engineered bacterium or genetically engineered virus that expresses a payload under the control of a promoter that is activated by conditions of cellular damage. In one embodiment, the gene for producing the payload is expressed under the control of a cellular damaged-dependent promoter that is activated in environments in which there is cellular or tissue damage, e.g., a reactive oxygen species or ROS promoter.

As used herein, "reactive oxygen species" and "ROS" are used interchangeably to refer to highly active molecules, ions, and/or radicals derived from molecular oxygen. ROS can be produced as byproducts of aerobic respiration or metal-catalyzed oxidation and may cause deleterious cellular effects such as oxidative damage. ROS includes, but is not limited to, hydrogen peroxide ($H_2O_2$), organic peroxide (ROOH), hydroxyl ion (OH—), hydroxyl radical (.OH), superoxide or superoxide anion (.$O_2$-), singlet oxygen ($1O_2$), ozone ($O_3$), carbonate radical, peroxide or peroxyl radical (.$O_2$-2), hypochlorous acid (HOCl), hypochlorite ion (OCl—), sodium hypochlorite (NaOCl), nitric oxide (NO.), and peroxynitrite or peroxynitrite anion (ONOO—) (unpaired electrons denoted by .). Bacteria have evolved transcription factors that are capable of sensing ROS levels. Different ROS signaling pathways are triggered by different ROS levels and occur with different kinetics (Marinho et al., 2014).

As used herein, "ROS-inducible regulatory region" refers to a nucleic acid sequence to which one or more ROS-sensing transcription factors is capable of binding, wherein the binding and/or activation of the corresponding transcription factor activates downstream gene expression; in the presence of ROS, the transcription factor binds to and/or activates the regulatory region. In some embodiments, the ROS-inducible regulatory region comprises a promoter sequence. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; in the presence of ROS, the transcription factor undergoes a conformational change, thereby activating downstream gene expression. The ROS-inducible regulatory region may be operatively linked to a gene sequence or gene sequence, e.g., a sequence or sequences encoding one or more payload(s). For example, in the presence of ROS, a transcription factor, e.g., OxyR, senses ROS and activates a corresponding ROS-inducible regulatory region, thereby driving expression of an operatively linked gene sequence or gene sequences. Thus, ROS induces expression of the gene or genes.

As used herein, "ROS-derepressible regulatory region" refers to a nucleic acid sequence to which one or more ROS-sensing transcription factors is capable of binding, wherein the binding of the corresponding transcription factor represses downstream gene expression; in the presence of ROS, the transcription factor does not bind to and does not repress the regulatory region. In some embodiments, the ROS-derepressible regulatory region comprises a promoter sequence. The ROS-derepressible regulatory region may be operatively linked to a gene or genes, e.g., one or more genes encoding one or more payload(s). For example, in the presence of ROS, a transcription factor, e.g., OhrR, senses ROS and no longer binds to and/or represses the regulatory region, thereby derepressing an operatively linked gene sequence or gene cassette. Thus, ROS derepresses expression of the gene or gene cassette.

As used herein, "ROS-repressible regulatory region" refers to a nucleic acid sequence to which one or more ROS-sensing transcription factors is capable of binding, wherein the binding of the corresponding transcription factor represses downstream gene expression; in the presence of ROS, the transcription factor binds to and represses the regulatory region. In some embodiments, the ROS-repressible regulatory region comprises a promoter sequence. In some embodiments, the transcription factor that senses ROS is capable of binding to a regulatory region that overlaps with part of the promoter sequence. In alternate embodiments, the transcription factor that senses ROS is capable of binding to a regulatory region that is upstream or downstream of the promoter sequence. The ROS-repressible regulatory region may be operatively linked to a gene sequence or gene sequences. For example, in the presence of ROS, a transcription factor, e.g., PerR, senses ROS and binds to a corresponding ROS-repressible regulatory region, thereby blocking expression of an operatively linked gene sequence or gene sequences. Thus, ROS represses expression of the gene or genes.

As used herein, a "ROS-responsive regulatory region" refers to a ROS-inducible regulatory region, a ROS-repressible regulatory region, and/or a ROS-derepressible regulatory region. In some embodiments, the ROS-responsive regulatory region comprises a promoter sequence. Each regulatory region is capable of binding at least one corresponding ROS-sensing transcription factor. Examples of transcription factors that sense ROS and their corresponding ROS-responsive genes, promoters, and/or regulatory regions include, but are not limited to, those shown in Table 10.

TABLE 10

Examples of ROS-sensing transcription factors and ROS-responsive genes

| ROS-sensing transcription factor: | Primarily capable of sensing: | Examples of responsive genes, promoters, and/or regulatory regions: |
|---|---|---|
| OxyR | $H_2O_2$ | ahpC; ahpF; dps; dsbG; fhuF; flu; fur; gor; grxA; hemH; katG; oxyS; sufA; sufB; sufC; sufD; sufE; sufS; trxC; uxuA; yaaA; yaeH; yaiA; ybjM; ydcH; ydeN; ygaQ; yljA; ytfK |
| PerR | $H_2O_2$ | katA; ahpCF; mrgA; zoaA; fur; hemAXCDBL; srfA |
| OhrR | Organic peroxides NaOCl | ohrA |
| SoxR | $\cdot O_2^-$ NO• (also capable of sensing $H_2O_2$) | soxS |
| RosR | $H_2O_2$ | rbtT; tnp16a; rluC1; tnp5a; mscL; tnp2d; phoD; tnp15b; pstA; tnp5b; xylC; gabD1; rluC2; cgtS9; azlC; narKGHJI; rosR |

In some embodiments, the genetically engineered bacteria comprise a tunable regulatory region that is directly or indirectly controlled by a transcription factor that is capable of sensing at least one reactive oxygen species. The tunable regulatory region is operatively linked to a gene or gene cassette capable of directly or indirectly driving the expression of a payload, thus controlling expression of the payload relative to ROS levels. For example, the tunable regulatory region is a ROS-inducible regulatory region, and the molecule is a payload; when ROS is present, e.g., in an inflamed tissue, a ROS-sensing transcription factor binds to and/or activates the regulatory region and drives expression of the gene sequence for the payload, thereby producing the payload. Subsequently, when inflammation is ameliorated, ROS levels are reduced, and production of the payload is decreased or eliminated.

In some embodiments, the tunable regulatory region is a ROS-inducible regulatory region; in the presence of ROS, a transcription factor senses ROS and activates the ROS-inducible regulatory region, thereby driving expression of an operatively linked gene or gene cassette. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; when the transcription factor senses ROS, it undergoes a conformational change, thereby inducing downstream gene expression.

In some embodiments, the tunable regulatory region is a ROS-inducible regulatory region, and the transcription factor that senses ROS is OxyR. OxyR "functions primarily as a global regulator of the peroxide stress response" and is capable of regulating dozens of genes, e.g., "genes involved in $H_2O_2$ detoxification (katE, ahpCF), heme biosynthesis (hemH), reductant supply (grxA, gor, trxC), thiol-disulfide isomerization (dsbG), Fe—S center repair (sufA-E, sufS), iron binding (yaaA), repression of iron import systems (fur)" and "OxyS, a small regulatory RNA" (Dubbs et al., 2012). The genetically engineered bacteria may comprise any suitable ROS-responsive regulatory region from a gene that is activated by OxyR. Genes that are capable of being activated by OxyR are known in the art (see, e.g., Zheng et al., 2001; Dubbs et al., 2012). In certain embodiments, the genetically engineered bacteria of the invention comprise a ROS-inducible regulatory region from oxyS that is operatively linked to a gene, e.g., a payload gene. In the presence of ROS, e.g., H2O2, an OxyR transcription factor senses ROS and activates to the oxyS regulatory region, thereby driving expression of the operatively linked payload gene and producing the payload. In some embodiments, OxyR is encoded by an E. coli oxyR gene. In some embodiments, the oxyS regulatory region is an E. coli oxyS regulatory region. In some embodiments, the ROS-inducible regulatory region is selected from the regulatory region of katG, dps, and ahpC.

In alternate embodiments, the tunable regulatory region is a ROS-inducible regulatory region, and the corresponding transcription factor that senses ROS is SoxR. When SoxR is "activated by oxidation of its [2Fe-2S] cluster, it increases the synthesis of SoxS, which then activates its target gene expression" (Koo et al., 2003). "SoxR is known to respond primarily to superoxide and nitric oxide" (Koo et al., 2003), and is also capable of responding to H2O2. The genetically engineered bacteria of the invention may comprise any suitable ROS-responsive regulatory region from a gene that is activated by SoxR. Genes that are capable of being activated by SoxR are known in the art (see, e.g., Koo et al., 2003). In certain embodiments, the genetically engineered bacteria of the invention comprise a ROS-inducible regulatory region from soxS that is operatively linked to a gene, e.g., a payload. In the presence of ROS, the SoxR transcription factor senses ROS and activates the soxS regulatory region, thereby driving expression of the operatively linked a payload gene and producing a payload.

In some embodiments, the tunable regulatory region is a ROS-derepressible regulatory region, and binding of a corresponding transcription factor represses downstream gene expression; in the presence of ROS, the transcription factor no longer binds to the regulatory region, thereby derepressing the operatively linked gene or gene cassette.

In some embodiments, the tunable regulatory region is a ROS-derepressible regulatory region, and the transcription factor that senses ROS is OhrR. OhrR "binds to a pair of inverted repeat DNA sequences overlapping the ohrA promoter site and thereby represses the transcription event," but oxidized OhrR is "unable to bind its DNA target" (Duarte et al., 2010). OhrR is a "transcriptional repressor [that] . . . senses both organic peroxides and NaOCl" (Dubbs et al., 2012) and is "weakly activated by H2O2 but it shows much higher reactivity for organic hydroperoxides" (Duarte et al., 2010). The genetically engineered bacteria of the invention may comprise any suitable ROS-responsive regulatory region from a gene that is repressed by OhrR. Genes that are capable of being repressed by OhrR are known in the art (see, e.g., Dubbs et al., 2012). In certain embodiments, the genetically engineered bacteria of the invention comprise a ROS-derepressible regulatory region from ohrA that is operatively linked to a gene or gene cassette, e.g., a payload gene. In the presence of ROS, e.g., NaOCl, an OhrR transcription factor senses ROS and no longer binds to the ohrA regulatory region, thereby derepressing the operatively linked payload gene and producing a payload.

OhrR is a member of the MarR family of ROS-responsive regulators. "Most members of the MarR family are transcriptional repressors and often bind to the –10 or –35 region in the promoter causing a steric inhibition of RNA polymerase binding" (Bussmann et al., 2010). Other members of this family are known in the art and include, but are not limited to, OspR, MgrA, RosR, and SarZ. In some embodiments, the transcription factor that senses ROS is OspR, MgRA, RosR, and/or SarZ, and the genetically engineered bacteria of the invention comprises one or more corresponding regulatory region sequences from a gene that is repressed by OspR, MgRA, RosR, and/or SarZ. Genes that are capable of being repressed by OspR, MgRA, RosR, and/or SarZ are known in the art (see, e.g., Dubbs et al., 2012).

In some embodiments, the tunable regulatory region is a ROS-derepressible regulatory region, and the corresponding transcription factor that senses ROS is RosR. RosR is "a MarR-type transcriptional regulator" that binds to an "18-bp inverted repeat with the consensus sequence TTGTTGAY-RYRTCAACWA" (SEQ ID NO: 1249) and is "reversibly inhibited by the oxidant H2O2" (Bussmann et al., 2010). RosR is capable of repressing numerous genes and putative genes, including but not limited to "a putative polyisoprenoid-binding protein (cg1322, gene upstream of and divergent from rosR), a sensory histidine kinase (cgtS9), a putative transcriptional regulator of the Crp/FNR family (cg3291), a protein of the glutathione S-transferase family (cg1426), two putative FMN reductases (cg1150 and cg1850), and four putative monooxygenases (cg0823, cg1848, cg2329, and cg3084)" (Bussmann et al., 2010). The genetically engineered bacteria of the invention may comprise any suitable ROS-responsive regulatory region from a gene that is repressed by RosR. Genes that are capable of being repressed by RosR are known in the art (see, e.g., Bussmann et al., 2010). In certain embodiments, the genetically engineered bacteria of the invention comprise a ROS-derepressible regulatory region from cgtS9 that is operatively linked to a gene or gene cassette, e.g., a payload. In the presence of ROS, e.g., H2O2, a RosR transcription factor senses ROS and no longer binds to the cgtS9 regulatory region, thereby derepressing the operatively linked payload gene and producing the payload.

In some embodiments, it is advantageous for the genetically engineered bacteria to express a ROS-sensing transcription factor that does not regulate the expression of a significant number of native genes in the bacteria. In some embodiments, the genetically engineered bacterium of the invention expresses a ROS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the ROS-sensing transcription factor is RosR, e.g., from *Corynebacterium glutamicum*, wherein the *Escherichia coli* does not comprise binding sites for said RosR. In some embodiments, the heterologous transcription factor minimizes or eliminates off-target effects on endogenous regulatory regions and genes in the genetically engineered bacteria.

In some embodiments, the tunable regulatory region is a ROS-repressible regulatory region, and binding of a corresponding transcription factor represses downstream gene expression; in the presence of ROS, the transcription factor senses ROS and binds to the ROS-repressible regulatory region, thereby repressing expression of the operatively linked gene or gene cassette. In some embodiments, the ROS-sensing transcription factor is capable of binding to a regulatory region that overlaps with part of the promoter sequence. In alternate embodiments, the ROS-sensing transcription factor is capable of binding to a regulatory region that is upstream or downstream of the promoter sequence.

In some embodiments, the tunable regulatory region is a ROS-repressible regulatory region, and the transcription factor that senses ROS is PerR. In *Bacillus subtilis*, PerR "when bound to DNA, represses the genes coding for proteins involved in the oxidative stress response (katA, ahpC, and mrgA), metal homeostasis (hemAXCDBL, fur, and zoaA) and its own synthesis (perR)" (Marinho et al., 2014). PerR is a "global regulator that responds primarily to H2O2" (Dubbs et al., 2012) and "interacts with DNA at the per box, a specific palindromic consensus sequence (TTATAATNATTATAA) (SEQ ID NO: 113) residing within and near the promoter sequences of PerR-controlled genes" (Marinho et al., 2014). PerR is capable of binding a regulatory region that "overlaps part of the promoter or is immediately downstream from it" (Dubbs et al., 2012). The genetically engineered bacteria of the invention may comprise any suitable ROS-responsive regulatory region from a gene that is repressed by PerR. Genes that are capable of being repressed by PerR are known in the art (see, e.g., Dubbs et al., 2012).

In these embodiments, the genetically engineered bacteria may comprise a two repressor activation regulatory circuit, which is used to express a payload. The two repressor activation regulatory circuit comprises a first ROS-sensing repressor, e.g., PerR, and a second repressor, e.g., TetR, which is operatively linked to a gene or gene cassette, e.g., a payload. In one aspect of these embodiments, the ROS-sensing repressor inhibits transcription of the second repressor, which inhibits the transcription of the gene or gene cassette. Examples of second repressors useful in these embodiments include, but are not limited to, TetR, Cl, and LexA. In some embodiments, the ROS-sensing repressor is PerR. In some embodiments, the second repressor is TetR. In this embodiment, a PerR-repressible regulatory region drives expression of TetR, and a TetR-repressible regulatory region drives expression of the gene or gene cassette, e.g., a payload. In the absence of PerR binding (which occurs in the absence of ROS), tetR is transcribed, and TetR represses expression of the gene or gene cassette, e.g., a payload. In the presence of PerR binding (which occurs in the presence of ROS), tetR expression is repressed, and the gene or gene cassette, e.g., a payload, is expressed.

A ROS-responsive transcription factor may induce, derepress, or repress gene expression depending upon the regulatory region sequence used in the genetically engineered bacteria. For example, although "OxyR is primarily thought of as a transcriptional activator under oxidizing conditions . . . OxyR can function as either a repressor or activator under both oxidizing and reducing conditions" (Dubbs et al., 2012), and OxyR "has been shown to be a repressor of its own expression as well as that of fhuF (encoding a ferric ion reductase) and flu (encoding the antigen 43 outer membrane protein)" (Zheng et al., 2001). The genetically engineered bacteria of the invention may comprise any suitable ROS-responsive regulatory region from a gene that is repressed by OxyR. In some embodiments, OxyR is used in a two repressor activation regulatory circuit, as described above. Genes that are capable of being repressed by OxyR are known in the art (see, e.g., Zheng et al., 2001). Or, for example, although RosR is capable of repressing a number of genes, it is also capable of activating certain genes, e.g., the narKGHJI operon. In some embodiments, the genetically engineered bacteria comprise any suitable ROS-responsive regulatory region from a gene that is activated by RosR. In addition, "PerR-mediated positive regulation has also been observed . . . and appears to involve PerR binding to distant upstream sites" (Dubbs et al., 2012). In some embodiments, the genetically engineered bacteria comprise any suitable ROS-responsive regulatory region from a gene that is activated by PerR.

One or more types of ROS-sensing transcription factors and corresponding regulatory region sequences may be present in genetically engineered bacteria. For example, "OhrR is found in both Gram-positive and Gram-negative bacteria and can coreside with either OxyR or PerR or both" (Dubbs et al., 2012). In some embodiments, the genetically engineered bacteria comprise one type of ROS-sensing transcription factor, e.g., OxyR, and one corresponding regulatory region sequence, e.g., from oxyS. In some embodiments, the genetically engineered bacteria comprise one type of ROS-sensing transcription factor, e.g., OxyR, and two or more different corresponding regulatory region sequences, e.g., from oxyS and katG. In some embodiments, the genetically engineered bacteria comprise two or more types of ROS-sensing transcription factors, e.g., OxyR and PerR, and two or more corresponding regulatory region sequences, e.g., from oxyS and katA, respectively. One ROS-responsive regulatory region may be capable of binding more than one transcription factor. In some embodiments, the genetically engineered bacteria comprise two or more types of ROS-sensing transcription factors and one corresponding regulatory region sequence.

Nucleic acid sequences of several exemplary OxyR-regulated regulatory regions are shown in Table 10. OxyR binding sites are underlined and bolded. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 580, SEQ ID NO: 581, SEQ ID NO: 582, or SEQ ID NO: 583, or a functional fragment thereof.

In some embodiments, the regulatory region sequence is at least about 80%, at least about 85%, at least about 90%, at least about 95%, or at least about 99% homologous to the sequence of SEQ ID NO: 580, SEQ ID NO: 581, SEQ ID NO: 582, and/or SEQ ID NO: 583.

In some embodiments, the genetically engineered bacteria of the invention comprise a gene encoding a ROS-sensing transcription factor, e.g., the oxyR gene, that is controlled by its native promoter, an inducible promoter, a promoter that is stronger than the native promoter, e.g., the GlnRS promoter or the P(Bla) promoter, or a cconstitutive promoter. In some instances, it may be advantageous to express the ROS-sensing transcription factor under the control of an inducible promoter in order to enhance expression stability. In some embodiments, expression of the ROS-sensing transcription factor is controlled by a different promoter than the promoter that controls expression of the therapeutic molecule. In some embodiments, expression of the ROS-sensing transcription factor is controlled by the same promoter that controls expression of the therapeutic molecule. In some embodiments, the ROS-sensing transcription factor and therapeutic molecule are divergently transcribed from a promoter region.

In some embodiments, the genetically engineered bacteria of the invention comprise a gene for a ROS-sensing transcription factor from a different species, strain, or substrain of bacteria. In some embodiments, the genetically engineered bacteria comprise a ROS-responsive regulatory region from a different species, strain, or substrain of bacteria. In some embodiments, the genetically engineered bacteria comprise a ROS-sensing transcription factor and corresponding ROS-responsive regulatory region from a different species, strain, or substrain of bacteria. The heterologous ROS-sensing transcription factor and regulatory region may increase the transcription of genes operatively linked to said regulatory region in the presence of ROS, as compared to the native transcription factor and regulatory region from bacteria of the same subtype under the same conditions.

In some embodiments, the genetically engineered bacteria comprise a ROS-sensing transcription factor, OxyR, and corresponding regulatory region, oxyS, from *Escherichia coli*. In some embodiments, the native ROS-sensing transcription factor, e.g., OxyR, is left intact and retains wild-type activity. In alternate embodiments, the native ROS-sensing transcription factor, e.g., OxyR, is deleted or mutated to reduce or eliminate wild-type activity.

In some embodiments, the genetically engineered bacteria of the invention comprise multiple copies of the endogenous gene encoding the ROS-sensing transcription factor, e.g., the oxyR gene. In some embodiments, the gene encoding the ROS-sensing transcription factor is present on a plasmid. In some embodiments, the gene encoding the ROS-sensing transcription factor and the gene or gene cassette for producing the therapeutic molecule are present on different plasmids. In some embodiments, the gene encoding the ROS-sensing transcription factor and the gene or gene cassette for producing the therapeutic molecule are present on the same. In some embodiments, the gene encoding the ROS-sensing transcription factor is present on a chromosome. In some embodiments, the gene encoding the ROS-sensing transcription factor and the gene or gene cassette for producing the therapeutic molecule are present on different chromosomes. In some embodiments, the gene encoding the ROS-sensing transcription factor and the gene or gene cassette for producing the therapeutic molecule are present on the same chromosome.

In some embodiments, the genetically engineered bacteria comprise a wild-type gene encoding a ROS-sensing transcription factor, e.g., the soxR gene, and a corresponding regulatory region, e.g., a soxS regulatory region, that is mutated relative to the wild-type regulatory region from bacteria of the same subtype. The mutated regulatory region increases the expression of the payload in the presence of ROS, as compared to the wild-type regulatory region under the same conditions. In some embodiments, the genetically engineered bacteria comprise a wild-type ROS-responsive regulatory region, e.g., the oxyS regulatory region, and a corresponding transcription factor, e.g., OxyR, that is mutated relative to the wild-type transcription factor from bacteria of the same subtype. The mutant transcription factor increases the expression of the payload in the presence of ROS, as compared to the wild-type transcription factor under the same conditions. In some embodiments, both the ROS-sensing transcription factor and corresponding regulatory region are mutated relative to the wild-type sequences from bacteria of the same subtype in order to increase expression of the payload in the presence of ROS.

In some embodiments, the gene or gene cassette for producing the payload is present on a plasmid and operably linked to a promoter that is induced by ROS. In some embodiments, the gene or gene cassette for producing the payload is present in the chromosome and operably linked to a promoter that is induced by ROS. In some embodiments, the gene or gene cassette for producing the payload is present on a chromosome and operably linked to a promoter that is induced by exposure to tetracycline. In some embodiments, the gene or gene cassette for producing the payload is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria may comprise multiple copies of the gene(s) capable of producing a payload(s). In some embodiments, the gene(s) capable of producing a payload(s) is present on a plasmid and operatively linked to a ROS-responsive regulatory region. In some embodiments, the gene(s) capable of producing a payload is present in a chromosome and operatively linked to a ROS-responsive regulatory region.

Thus, in some embodiments, the genetically engineered bacteria or genetically engineered virus produce one or more payloads under the control of an oxygen level-dependent promoter, a reactive oxygen species (ROS)-dependent promoter, or a reactive nitrogen species (RNS)-dependent promoter, and a corresponding transcription factor.

In some embodiments, the genetically engineered bacteria comprise a stably maintained plasmid or chromosome carrying a gene for producing a payload, such that the payload can be expressed in the host cell, and the host cell is capable of survival and/or growth in vitro, e.g., in medium, and/or in vivo. In some embodiments, a bacterium may comprise multiple copies of the gene encoding the payload. In some embodiments, the gene encoding the payload is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the gene encoding the payload is expressed on a high-copy plasmid. In some embodiments, the high-copy plasmid may be useful for increasing expression of the payload. In some embodiments, the gene encoding the payload is expressed on a chromosome.

Other Promoters

In some embodiments, the genetically engineered bacteria comprise the gene or gene cassette for producing anti-cancer molecule expressed under the control of an inducible promoter that is responsive to specific molecules or metabolites in the environment, e.g., the tumor microenvironment, a specific tissue, or the mammalian gut. Any molecule or metabolite found in the mammalian gut, in a healthy and/or disease state, or in the tumor microenvironment, may be used to induce payload expression.

In alternate embodiments, the gene or gene cassette for producing anti-cancer molecule is operably linked to a nutritional or chemical inducer which is not present in the environment, e.g., the tumor microenvironment, a specific tissue, or the mammalian gut. In some embodiments, the nutritional or chemical inducer is administered prior, concurrently or sequentially with the genetically engineered bacteria.

In some embodiments, the gene or gene cassette for producing the anti-cancer molecule is operably linked to a promoter that is induced under low-oxygen or anaerobic conditions.

Other Inducible Promoters

In some embodiments, the gene encoding the anti-cancer molecule is present on a plasmid and operably linked to a promoter that is induced by one or more nutritional and/or chemical inducer(s) and/or metabolite(s). In some embodiments, the gene encoding the anti-cancer molecule is present in the chromosome and operably linked to a promoter that is induced by one or more nutritional and/or chemical inducer(s) and/or metabolite(s).

In some embodiments, the bacterial cell comprises a stably maintained plasmid or chromosome carrying the one or more gene sequences(s), inducible by one or more nutritional and/or chemical inducer(s) and/or metabolite(s), encoding the anti-cancer molecule, such that the anti-cancer molecule can be expressed in the host cell, and the host cell is capable of survival and/or growth in vitro, e.g., in medium, and/or in vivo, e.g., in the tumor or in the gut. In some embodiments, bacterial cell comprises two or more distinct copies of the one or more gene sequences(s) encoding the anti-cancer molecule, which is controlled by a promoter inducible one or more nutritional and/or chemical inducer(s) and/or metabolite(s). In some embodiments, the genetically engineered bacteria comprise multiple copies of the same one or more gene sequences(s) encoding the anti-cancer molecule, which is controlled by a promoter inducible one or more nutritional and/or chemical inducer(s) and/or metabolite(s). In some embodiments, the one or more gene sequences(s) encoding the anti-cancer molecule(s), is present on a plasmid and operably linked to a directly or indirectly inducible promoter inducible by one or more nutritional and/or chemical inducer(s) and/or metabolite(s). In some embodiments, the one or more gene sequences(s) encoding the anti-cancer molecule, is present on a chromosome and operably linked to a directly or indirectly inducible by one or more nutritional and/or chemical inducer(s) and/or metabolite(s).

In some embodiments, one or more gene sequence(s) encoding polypeptides of interest described herein is present on a plasmid and operably linked to promoter a directly or indirectly inducible by one or more nutritional and/or chemical inducer(s) and/or metabolite(s). In some embodiments, the bacterial cell comprises a stably maintained plasmid or chromosome carrying the gene encoding the anti-cancer molecule, which is induced by one or more nutritional and/or chemical inducer(s) and/or metabolite(s), such that the anti-cancer molecule can be expressed in the host cell, and the host cell is capable of survival and/or growth in vitro, e.g., under culture conditions, and/or in vivo, e.g., in the gut and/or the tumor microenvironment. In some embodiments, bacterial cell comprises two or more gene sequence(s) for the production of a polypeptide of interest, one or more of which are induced by one or more nutritional and/or chemical inducer(s) and/or metabolite(s). In some embodiments, the genetically engineered bacteria comprise multiple copies of the same gene sequence(s) for the production of a polypeptide of interest which are induced by one or more nutritional and/or chemical inducer(s) and/or metabolite(s). In some embodiments, the genetically engineered bacteria comprise multiple copies of different gene sequence(s) for the production of a polypeptide of interest, one or more of which are induced by one or more nutritional and/or chemical inducer(s) and/or metabolite(s).

In some embodiments, the gene sequence(s) for the production of a polypeptide of interest is present on a plasmid and operably linked to a promoter that is induced by one or more nutritional and/or chemical inducer(s) and/or metabolite(s). In some embodiments, gene sequence(s) for the production of a polypeptide of interest is present in the chromosome and operably linked to a promoter that is induced by one or more nutritional and/or chemical inducer(s) and/or metabolite(s).

In some embodiments, the promoter that is operably linked to the gene encoding the polypeptide of interest is directly or indirectly induced by one or more nutritional and/or chemical inducer(s) and/or metabolite(s).

In some embodiments, one or more inducible promoter(s) are useful for or induced during in vivo expression of the one or more protein(s) of interest. In some embodiments, the promoters are induced during in vivo expression of one or more anti-cancer molecules and/or other polypeptide(s) of interest. In some embodiments, expression of one or more anti-cancer molecule(s) and/or other polypeptide(s) of interest is driven directly or indirectly by one or more arabinose inducible promoter(s) in vivo. In some embodiments, the promoter is directly or indirectly induced by a chemical and/or nutritional inducer and/or metabolite which is co-administered with the genetically engineered bacteria of the invention.

In some embodiments, expression of one or more anti-cancer molecule and/or other polypeptide(s) of interest, is driven directly or indirectly by one or more promoter(s) induced by a chemical and/or nutritional inducer and/or metabolite during in vitro growth, preparation, or manufacturing of the strain prior to in vivo administration. In some embodiments, the promoter(s) induced by a chemical and/or nutritional inducer and/or metabolite are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with anti-cancer molecule(s) and/or other polypeptide(s) of interest prior to administration. In some embodiments, the cultures, which are induced by a chemical and/or nutritional inducer and/or metabolite, are grown aerobically. In some embodiments, the cultures, which are induced by a chemical and/or nutritional inducer and/or metabolite, are grown anaerobically.

The genes of arabinose metabolism are organized in one operon, AraBAD, which is controlled by the PAraBAD promoter. The PAraBAD (or Para) promoter suitably fulfills the criteria of inducible expression systems. PAraBAD displays tighter control of payload gene expression than many other systems, likely due to the dual regulatory role of AraC, which functions both as an inducer and as a repressor. Additionally, the level of PAraBAD-based expression can be modulated over a wide range of L-arabinose concentrations to fine-tune levels of expression of the payload. However, the cell population exposed to sub-saturating L-arabinose concentrations is divided into two subpopulations of induced and uninduced cells, which is determined by the differences between individual cells in the availability of L-arabinose transporter (Zhang et al., Development and Application of an Arabinose-Inducible Expression System by Facilitating Inducer Uptake in *Corynebacterium glutamicum*; Appl. Environ. Microbiol. August 2012 vol. 78 no. 16 5831-5838). Alternatively, inducible expression from the ParaBad can be controlled or fine-tuned through the optimization of the ribosome binding site (RBS), as described herein.

In one embodiment, expression of one or more anti-cancer molecule protein(s) of interest, e.g., one or more therapeutic polypeptide(s), is driven directly or indirectly by one or more arabinose inducible promoter(s).

In some embodiments, the arabinose inducible promoter is useful for or induced during in vivo expression of the one or more protein(s) of interest. In some embodiments, expression of one or more anti-cancer molecule protein(s) of interest is driven directly or indirectly by one or more arabinose inducible promoter(s) in vivo. In some embodiments, the promoter is directly or indirectly induced by a molecule that is co-administered with the genetically engineered bacteria of the invention, e.g., arabinose.

In some embodiments, expression of one or more protein(s) of interest, is driven directly or indirectly by one or more arabinose inducible promoter(s) during in vitro growth, preparation, or manufacturing of the strain prior to in vivo administration. In some embodiments, the arabinose inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., arabinose. In some embodiments, the cultures, which are induced by arabinose, are grown aerobically. In some embodiments, the cultures, which are induced by arabinose, are grown anaerobically.

In one embodiment, the arabinose inducible promoter drives the expression of a construct comprising one or more protein(s) of interest, jointly with a second promoter, e.g., a second constitutive or inducible promoter. In some embodiments, two promoters are positioned proximally to the construct and drive its expression, wherein the arabinose inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., arabinose and IPTG). In another non-limiting example, the first inducing conditions may be culture conditions, e.g., including arabinose presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more arabinose promoters drive expression of one or more protein(s) of interest, in combination with the FNR promoter driving the expression of the same gene sequence(s).

In some embodiments, the arabinose inducible promoter drives the expression of one or more protein(s) of interest from a low-copy plasmid or a high copy plasmid or a biosafety system plasmid described herein. In some embodiments, the arabinose inducible promoter drives the expression of one or more protein(s) of interest from a construct which is integrated into the bacterial chromosome. Exemplary insertion sites are described herein.

In some embodiments, one or more protein(s) of interest are knocked into the arabinose operon and are driven by the native arabinose inducible promoter In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 585. In some embodiments, the arabinose inducible construct further comprises a gene encoding AraC, which is divergently transcribed from the same promoter as the one or more one or more protein(s) of interest. In another embodiment, the genetically engineered bacteria comprise a gene sequence comprising SEQ ID NO: 585. In another embodiment, the genetically engineered bacteria comprise a gene sequence which consists of SEQ ID NO: 585.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 586. In another embodiment, the genetically engineered bacteria comprise a gene sequence comprising SEQ ID NO: 586. In another embodiment, the genetically engineered bacteria comprise a gene sequence which consists of SEQ ID NO: 586.

In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by SEQ ID NO: 587. In another embodiment, the genetically engineered bacteria comprise a gene sequence encoding a polypeptide comprising SEQ ID NO: 587. In yet another embodiment, the polypeptide expressed by the genetically engineered bacteria consists of SEQ ID NO: 587.

In some embodiments, the genetically engineered bacteria comprise one or more gene sequence(s) which are inducible through a rhamnose inducible system. The genes rhaBAD are organized in one operon which is controlled by the rhaP BAD promoter. The rhaP BAD promoter is regulated by two activators, RhaS and RhaR, and the corresponding genes belong to one transcription unit which divergently transcribed in the opposite direction of rhaBAD. In the presence of L-rhamnose, RhaR binds to the rhaP RS promoter and activates the production of RhaR and RhaS. RhaS together with L-rhamnose then bind to the rhaP BAD and the rhaP T promoter and activate the transcription of the structural genes. In contrast to the arabinose system, in which AraC is provided and divergently transcribed in the gene sequence(s), it is not necessary to express the regulatory proteins in larger quantities in the rhamnose expression system because the amounts expressed from the chromosome are sufficient to activate transcription even on multicopy plasmids. Therefore, only the rhaP BAD promoter is cloned upstream of the gene that is to be expressed. Full induction of rhaBAD transcription also requires binding of the CRP-cAMP complex, which is a key regulator of catabolite repression. Alternatively, inducible expression from the rhaBAD can be controlled or fine-tuned through the optimization of the ribosome binding site (RBS), as described herein.

In one embodiment, expression of one or more protein(s) of interest is driven directly or indirectly by one or more rhamnose inducible promoter(s). In one embodiment, expression of the payload is driven directly or indirectly by a rhamnose inducible promoter.

In some embodiments, the rhamnose inducible promoter is useful for or induced during in vivo expression of the one or more protein(s) of interest. In some embodiments, expression of one or more protein(s) of interest is driven directly or indirectly by one or more rhamnose inducible promoter(s) in vivo. In some embodiments, the promoter is directly or indirectly induced by a molecule that is co-administered with the genetically engineered bacteria of the invention, e.g., rhamnose.

In some embodiments, expression of one or more protein(s) of interest, is driven directly or indirectly by one or more rhamnose inducible promoter(s) during in vitro growth, preparation, or manufacturing of the strain prior to in vivo administration. In some embodiments, the rhamnose inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., rhamnose. In some embodiments, the cultures, which are induced by rhamnose, are grown aerobically. In some embodiments, the cultures, which are induced by rhamnose, are grown anaerobically.

In one embodiment, the rhamnose inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the rhamnose inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., rhamnose and arabinose). In another non-limiting example, the first inducing conditions may be culture conditions, e.g., including rhamnose presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more rhamnose promoters drive expression of one or more protein(s) of interest and/or transcriptional regulator(s), e.g., FNRS24Y, in combination with the FNR promoter driving the expression of the same gene sequence(s).

In some embodiments, the rhamnose inducible promoter drives the expression of one or more protein(s) of interest, from a low-copy plasmid or a high copy plasmid or a biosafety system plasmid described herein. In some embodiments, the rhamnose inducible promoter drives the expression of one or more protein(s) of interest, from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 588. In another embodiment, the gene sequence comprises the sequence of SEQ ID NO: 588. In yet another embodiment, the gene sequence consists of SEQ ID NO: 588.

In some embodiments, the genetically engineered bacteria comprise one or more gene sequence(s) which are inducible through an Isopropyl β-D-1-thiogalactopyranoside (IPTG) inducible system or other compound which induced transcription from the Lac Promoter. IPTG is a molecular mimic of allolactose, a lactose metabolite that activates transcription of the lac operon. In contrast to allolactose, the sulfur atom in IPTG creates a non-hydrolysable chemical blond, which prevents the degradation of IPTG, allowing the concentration to remain constant. IPTG binds to the lac repressor and releases the tetrameric repressor (lacI) from the lac operator in an allosteric manner, thereby allowing the transcription of genes in the lac operon. Since IPTG is not metabolized by $E.$ $coli$, its concentration stays constant and the rate of expression of Lac promoter-controlled is tightly controlled, both in vivo and in vitro. IPTG intake is independent on the action of lactose permease, since other transport pathways are also involved. Inducible expression from the PLac can be controlled or fine-tuned through the optimization of the ribosome binding site (RBS), as described herein. Other compounds which inactivate LacI, can be used instead of IPTG in a similar manner.

In one embodiment, expression of one or more protein(s) of interest is driven directly or indirectly by one or more IPTG inducible promoter(s).

In some embodiments, the IPTG inducible promoter is useful for or induced during in vivo expression of the one or more protein(s) of interest. In some embodiments, expression of one or more protein(s) of interest is driven directly or indirectly by one or more IPTG inducible promoter(s) in vivo. In some embodiments, the promoter is directly or indirectly induced by a molecule that is co-administered with the genetically engineered bacteria of the invention, e.g., IPTG.

In some embodiments, expression of one or more protein(s) of interest is driven directly or indirectly by one or more IPTG inducible promoter(s) during in vitro growth, preparation, or manufacturing of the strain prior to in vivo administration. In some embodiments, the IPTG inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., IPTG. In some embodiments, the cultures, which are induced by IPTG, are grown aerobically. In some embodiments, the cultures, which are induced by IPTG, are grown anaerobically.

In one embodiment, the IPTG inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the IPTG inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., arabinose and IPTG). In another non-limiting example, the first inducing conditions may be culture conditions, e.g., including IPTG presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more IPTG inducible promoters drive expression of one or more protein(s) of interest in combination with the FNR promoter driving the expression of the same gene sequence(s).

In some embodiments, the IPTG inducible promoter drives the expression of one or more protein(s) of interest from a low-copy plasmid or a high copy plasmid or a biosafety system plasmid described herein. In some embodiments, the IPTG inducible promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 589. In another embodiment, the one or more gene sequence(s) comprise SEQ ID NO: SEQ ID NO: 589. In yet another embodiment, the one or more gene sequence(s) consist of SEQ ID NO: 589.

In some embodiments, the IPTG inducible construct further comprises a gene encoding lacI, which is divergently transcribed from the same promoter as the one or more one or more protein(s) of interest. In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 590. In another embodiment, the one or more gene sequence(s) comprise SEQ ID NO: SEQ ID NO: 590. In yet another embodiment, the one or more gene sequence(s) consist of SEQ ID NO: 590.

In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 591. In another embodiment, the genetically engineered bacteria comprise a gene sequence encoding a polypeptide comprising SEQ ID NO: 591. In yet another embodiment, the polypeptide expressed by the genetically engineered bacteria consists of SEQ ID NO: 591.

In some embodiments, the genetically engineered bacteria comprise one or more gene sequence(s) which are inducible through a tetracycline inducible system. The initial system Gossen and Bujard (Tight control of gene expression in mammalian cells by tetracycline-responsive promoters. Gossen M & Bujard H. $PNAS,$ 1992 Jun. 15; 89(12):5547-51) developed is known as tetracycline off: in the presence of tetracycline, expression from a tet-inducible promoter is reduced. Tetracycline-controlled transactivator (tTA) was created by fusing tetR with the C-terminal domain of VP16

(virion protein 16) from herpes simplex virus. In the absence of tetracycline, the tetR portion of tTA will bind tetO sequences in the tet promoter, and the activation domain promotes expression. In the presence of tetracycline, tetracycline binds to tetR, precluding tTA from binding to the tetO sequences. Next, a reverse Tet repressor (rTetR), was developed which created a reliance on the presence of tetracycline for induction, rather than repression. The new transactivator rtTA (reverse tetracycline-controlled transactivator) was created by fusing rTetR with VP16. The tetracycline on system is also known as the rtTA-dependent system.

In one embodiment, expression of one or more protein(s) of interest is driven directly or indirectly by one or more tetracycline inducible promoter(s).

In some embodiments, the tetracycline inducible promoter is useful for or induced during in vivo expression of the one or more protein(s) of interest. In some embodiments, expression of one or more protein(s) of interest and/or transcriptional regulator(s), e.g., FNRS24Y, is driven directly or indirectly by one or more tetracycline inducible promoter(s) in vivo. In some embodiments, the promoter is directly or indirectly induced by a molecule that is co-administered with the genetically engineered bacteria of the invention, e.g., tetracycline In some embodiments, expression of one or more protein(s) of interest is driven directly or indirectly by one or more tetracycline inducible promoter(s) during in vitro growth, preparation, or manufacturing of the strain prior to in vivo administration. In some embodiments, the tetracycline inducible promoter(s) are induced in culture, e.g., grown in a flask, fermenter or other appropriate culture vessel, e.g., used during cell growth, cell expansion, fermentation, recovery, purification, formulation, and/or manufacture. In some embodiments, the promoter is directly or indirectly induced by a molecule that is added to in the bacterial culture to induce expression and pre-load the bacterium with the payload prior to administration, e.g., tetracycline. In some embodiments, the cultures, which are induced by tetracycline, are grown aerobically. In some embodiments, the cultures, which are induced by tetracycline, are grown anaerobically.

In one embodiment, the tetracycline inducible promoter drives the expression of a construct comprising one or more protein(s) of interest jointly with a second promoter, e.g., a second constitutive or inducible promoter. In some embodiments, two promoters are positioned proximally to the construct and drive its expression, wherein the tetracycline inducible promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., tetracycline and IPTG). In another non-limiting example, the first inducing conditions may be culture conditions, e.g., including tetracycline presence, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more tetracycline promoters drive expression of one or more protein(s) of interest in combination with the FNR promoter driving the expression of the same gene sequence(s).

In some embodiments, the tetracycline inducible promoter drives the expression of one or more protein(s) of interest from a low-copy plasmid or a high copy plasmid or a biosafety system plasmid described herein. In some embodiments, the tetracycline inducible promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the bolded sequences of SEQ ID NO: 596 (tet promoter is in bold). In another embodiment, the one or more gene sequence(s) comprise SEQ ID NO: SEQ ID NO: 596. In yet another embodiment, the one or more gene sequence(s) consist of SEQ ID NO: 596.

In some embodiments, the tetracycline inducible construct further comprises a gene encoding AraC, which is divergently transcribed from the same promoter as the one or more one or more protein(s) of interest In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 596 in italics (Tet repressor is in italics). In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 596 in italics (Tet repressor is in italics). In one embodiment, the polypeptide comprises SEQ ID NO: 596. In one embodiment, the polypeptide consists of SEQ ID NO: 596.

In some embodiments, the genetically engineered bacteria comprise one or more gene sequence(s) whose expression is controlled by a temperature sensitive mechanism. Thermoregulators are advantageous because of strong transcriptional control without the use of external chemicals or specialized media (see, e.g., Nemani et al., Magnetic nanoparticle hyperthermia induced cytosine deaminase expression in microencapsulated $E.$ $coli$ for enzyme-prodrug therapy; J Biotechnol. 2015 Jun. 10; 203: 32-40, and references therein). Thermoregulated protein expression using the mutant cI857 repressor and the pL and/or pR phage $\lambda$ promoters have been used to engineer recombinant bacterial strains. The gene of interest cloned downstream of the $\lambda$ promoters can then be efficiently regulated by the mutant thermolabile cI857 repressor of bacteriophage $\lambda$. At temperatures below 37° C., cI857 binds to the oL or oR regions of the pR promoter and blocks transcription by RNA polymerase. At higher temperatures, the functional cI857 dimer is destabilized, binding to the oL or oR DNA sequences is abrogated, and mRNA transcription is initiated.

Inducible expression from the ParaBad can be controlled or further fine-tuned through the optimization of the ribosome binding site (RBS), as described herein.

In one embodiment, expression of one or more protein(s) of interest is driven directly or indirectly by one or more thermoregulated promoter(s).

In some embodiments, the thermoregulated promoter is useful for or induced during in vivo expression of the one or more protein(s) of interest. In some embodiments, expression of one or more protein(s) of interest is driven directly or indirectly by one or more thermoregulated promoter(s) in vivo. In some embodiments, the promoter is directly or indirectly induced by a molecule that is co-administered with the genetically engineered bacteria of the invention, e.g., temperature.

In some embodiments, expression of one or more protein(s) of interest is driven directly or indirectly by one or more thermoregulated promoter(s) during in vitro growth, preparation, or manufacturing of the strain prior to in vivo administration. In some embodiments, it may be advantageous to shut off production of the one or more protein(s) of interest. This can be done in a thermoregulated system by growing the strain at lower temperatures, e.g., 30 C. Expression can then be induced by elevating the temperature to 37 C and/or 42 C. In some embodiments, the thermoregulated promoter(s) are induced in culture, e.g., grown in a flask, fermenter or other appropriate culture vessel, e.g., used during cell growth, cell expansion, fermentation, recovery, purification, formulation, and/or manufacture. In some embodiments, the cultures, which are induced by temperatures between 37 C and 42 C, are grown aerobically. In some embodiments, the cultures, which are induced by induced by temperatures between 37 C and 42 C, are grown anaerobically.

In one embodiment, the thermoregulated promoter drives the expression of a construct comprising one or more protein(s) of interest jointly with a second promoter, e.g., a second constitutive or inducible promoter. In some embodiments, two promoters are positioned proximally to the construct and drive its expression, wherein the thermoregulated promoter drives expression under a first set of exogenous conditions, and the second promoter drives the expression under a second set of exogenous conditions. In a non-limiting example, the first and second conditions may be two sequential culture conditions (i.e., during preparation of the culture in a flask, fermenter or other appropriate culture vessel, e.g., thermoregulation and arabinose). In another non-limiting example, the first inducing conditions may be culture conditions, e.g., permissive temperature, and the second inducing conditions may be in vivo conditions. Such in vivo conditions include low-oxygen, microaerobic, or anaerobic conditions, conditions of the tumor microenvironment, presence of gut metabolites, and/or metabolites administered in combination with the bacterial strain. In some embodiments, the one or more thermoregulated promoters drive expression of one or more protein(s) of interest in combination with the FNR promoter driving the expression of the same gene sequence(s).

In some embodiments, the thermoregulated promoter drives the expression of one or more protein(s) of interest from a low-copy plasmid or a high copy plasmid or a biosafety system plasmid described herein. In some embodiments, the thermoregulated promoter drives the expression of one or more protein(s) of interest from a construct which is integrated into the bacterial chromosome. Exemplary insertion sites are described herein.

In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 592. In another embodiment, the one or more gene sequence(s) comprise SEQ ID NO: SEQ ID NO: 592. In yet another embodiment, the one or more gene sequence(s) consist of SEQ ID NO: 592.

In some embodiments, the thermoregulated construct further comprises a gene encoding mutant cI857 repressor, which is divergently transcribed from the same promoter as the one or more one or more protein(s) of interest. In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 593. In another embodiment, the one or more gene sequence(s) comprise SEQ ID NO: SEQ ID NO: 593. In yet another embodiment, the one or more gene sequence(s) consist of SEQ ID NO: 593.

In some embodiments, the genetically engineered bacteria comprise one or more gene sequence(s) encoding a polypeptide having at least 80%, 81%, 82%, 83%, 84%, 85%, 86%, 87%, 88%, 89%, 90%, 91%, 92%, 93%, 94%, 95%, 96%, 97%, 98%, or 99% identity with the polypeptide encoded by any of the sequences of SEQ ID NO: 595. In one embodiment, the polypeptide comprises SEQ ID NO: 595. In one embodiment, the polypeptide consists of SEQ ID NO: 595.

In some embodiments, the genetically engineered bacteria comprise one or more gene sequence(s) which are indirectly inducible through a system driven by the PssB promoter. The Pssb promoter is active under aerobic conditions, and shuts off under anaerobic conditions.

This promoter can be used to express a gene of interest under aerobic conditions. This promoter can also be used to tightly control the expression of a gene product such that it is only expressed under anaerobic conditions. In this case, the oxygen induced PssB promoter induces the expression of a repressor, which represses the expression of a gene of interest. As a result, the gene of interest is only expressed in the absence of the repressor, i.e., under anaerobic conditions. This strategy has the advantage of an additional level of control for improved fine-tuning and tighter control.

In one embodiment, expression of one or more protein(s) of interest is indirectly regulated by a repressor expressed under the control of one or more PssB promoter(s).

In some embodiments, induction of the RssB promoter(s) indirectly drives the in vivo expression of one or more protein(s) of interest. In some embodiments, induction of the RssB promoter(s) indirectly drives the expression of one or more protein(s) of interest during in vitro growth, preparation, or manufacturing of the strain prior to in vivo administration. In some embodiments, conditions for induction of the RssB promoter(s) are provided in culture, e.g., in a flask, fermenter or other appropriate culture vessel, e.g., used during cell growth, cell expansion, fermentation, recovery, purification, formulation, and/or manufacture.

In some embodiments, the PssB promoter indirectly drives the expression of one or more protein(s) of interest from a low-copy plasmid or a high copy plasmid or a biosafety system plasmid described herein. In some embodiments, the PssB promoter indirectly drives the expression of one or more protein(s) of interest from a construct which is integrated into the bacterial chromosome. Exemplary insertion sites are described herein.

In another non-limiting example, this strategy can be used to control expression of thyA and/or dapA, e.g., to make a conditional auxotroph. The chromosomal copy of dapA or ThyA is knocked out. Under anaerobic conditions, dapA or thyA—as the case may be—are expressed, and the strain can grow in the absence of dap or thymidine. Under aerobic conditions, dapA or thyA expression is shut off, and the strain cannot grow in the absence of dap or thymidine. Such a strategy can, for example be employed to allow survival of bacteria under anaerobic conditions, e.g., the gut or conditions of the tumor microenvironment, but prevent survival under aerobic conditions (biosafety switch). In some embodiments, the genetically engineered bacteria comprise one or more gene sequence(s) having at least 80%, 81%, 82%, 83%, 84%, 85%, 86%, 87%, 88%, 89%, 90%, 91%, 92%, 93%, 94%, 95%, 96%, 97%, 98%, or 99% identity with any of the sequences of SEQ ID NO: 597. In another embodiment, the one or more gene sequence(s) comprise SEQ ID NO: 597. In yet another embodiment, the one or more gene sequence(s) consist of SEQ ID NO: 597.

Constitutive Promoters

In some embodiments, the gene encoding the payload is present on a plasmid and operably linked to a constitutive promoter. In some embodiments, the gene encoding the payload is present on a chromosome and operably linked to a constitutive promoter.

In some embodiments, the constitutive promoter is active under in vivo conditions, e.g., the gut and/or conditions of the tumor microenvironment, as described herein. In some embodiments, the promoters is active under in vitro conditions, e.g., various cell culture and/or cell manufacturing conditions, as described herein. In some embodiments, the constitutive promoter is active under in vivo conditions, e.g., the gut and/or conditions of the tumor microenvironment, as described herein, and under in vitro conditions, e.g., various cell culture and/or cell production and/or manufacturing conditions, as described herein.

In some embodiments, the constitutive promoter that is operably linked to the gene encoding the payload is active in various exogenous environmental conditions (e.g., in vivo and/or in vitro and/or production/manufacturing conditions).

In some embodiments, the constitutive promoter is active in exogenous environmental conditions specific to the gut of a mammal and/or conditions of the tumor microenvironment. In some embodiments, the constitutive promoter is active in exogenous environmental conditions specific to the small intestine of a mammal. In some embodiments, the constitutive promoter is active in low-oxygen or anaerobic conditions such as the environment of the mammalian gut and/or conditions of the tumor microenvironment. In some embodiments, the constitutive promoter is active in the presence of molecules or metabolites that are specific to the gut of a mammal and/or conditions of the tumor microenvironment. In some embodiments, the constitutive promoter is directly or indirectly induced by a molecule that is co-administered with the bacterial cell. In some embodiments, the constitutive promoter is active in the presence of molecules or metabolites or other conditions, that are present during in vitro culture, cell production and/or manufacturing conditions.

Bacterial constitutive promoters are known in the art. In some embodiments, the promoter is a Constitutive E. coli σ70 promoter or a derivative thereof. In some embodiments, the promoter comprises a sequence selected from SEQ ID NO: 598-690. In some embodiments, the constitutive promoter is at least about 80%, at least about 85%, at least about 90%, at least about 95%, or at least about 99% homologous to a sequence selected from SEQ ID NO: 598-690. In another embodiment, the promoter sequence comprises a sequence selected from SEQ ID NO: 598-690. In yet another embodiment, the promoter sequence consists of a sequence selected from SEQ ID NO: 598-690.

In some embodiments, the promoter is a constitutive E. coli $\sigma^S$ promoter or a derivative thereof. In some embodiments, the promoter comprises a sequence selected from SEQ ID NO: 691 and 692. In some embodiments, the constitutive promoter is at least about 80%, at least about 85%, at least about 90%, at least about 95%, or at least about 99% homologous to the sequence of any one of SEQ ID NO: 691 and 692. In some embodiments, the promoter is a constitutive E. coli σ32 promoter or a derivative thereof. In some embodiments, the promoter comprises a sequence selected from SEQ ID NO: 693-695. In some embodiments, the constitutive promoter is at least about 80%, at least about 85%, at least about 90%, at least about 95%, or at least about 99% homologous to the sequence of any one of SEQ ID NO: 693-695. In some embodiments, the promoter is a constitutive B. subtilis GA promoter or a derivative thereof. In some embodiments, the promoter comprises a sequence selected from SEQ ID NO: 696-701. In some embodiments, the constitutive promoter is at least about 80%, at least about 85%, at least about 90%, at least about 95%, or at least about 99% homologous to the sequence of any one of SEQ ID NO: 696-701. In some embodiments, the promoter is a constitutive B. subtilis $\sigma^B$ promoter or a derivative thereof. In some embodiments, the promoter comprises a sequence selected from SEQ ID NO: 702-704. In some embodiments, the constitutive promoter is at least about 80%, at least about 85%, at least about 90%, at least about 95%, or at least about 99% homologous to the sequence of any one of SEQ ID NO: 702-704. In some embodiments, the promoter is a constitutive promoter from Salmonella or a derivative thereof. In some embodiments, the promoter comprises a sequence selected from SEQ ID NO: 705 and 706. In some embodiments, the constitutive promoter is at least about 80%, at least about 85%, at least about 90%, at least about 95%, or at least about 99% homologous to the sequence of any one of SEQ ID NO: 705 and 706. In some embodiments, the promoter is a constitutive promoter from bacteriophage T7 or a derivative thereof. In some embodiments, the promoter comprises a sequence selected from SEQ ID NO: 707 and 722. In some embodiments, the constitutive promoter is at least about 80%, at least about 85%, at least about 90%, at least about 95%, or at least about 99% homologous to the sequence of any one of SEQ ID NO: 707 and 722.

In some embodiments, the promoter is a constitutive promoter from bacteriophage SP6 or a derivative thereof. In some embodiments, the promoter comprises a sequence selected from SEQ ID NO: 723. In some embodiments, the constitutive promoter is at least about 80%, at least about 85%, at least about 90%, at least about 95%, or at least about 99% homologous to the sequence of any one of SEQ ID NO: 723. In some embodiments, the promoter is a constitutive promoter from yeast or a derivative thereof. In some embodiments, the promoter comprises a sequence selected from SEQ ID NO: 724-737. In some embodiments, the constitutive promoter is at least about 80%, at least about 85%, at least about 90%, at least about 95%, or at least about 99% homologous to the sequence of any one of SEQ ID NO: 724-737.

In some embodiments, the promoter is a constitutive promoter selected from CMV and Ubc or a derivative thereof. In some embodiments, In some embodiments, the promoter comprises a sequence selected from SEQ ID NO: 738 and 739. In some embodiments, the constitutive promoter is at least about 80%, at least about 85%, at least about 90%, at least about 95%, or at least about 99% homologous to the sequence of any one of SEQ ID NO: 738 and 739.

TABLE 11

Promoters

| Name | Description | SEQ ID NO |
|---|---|---|
| Plpp | The Plpp promoter is a natural promoter taken from the Nissle genome. In situ it is used to drive production of l pp which is known to be the most abundant protein in the cell. Also, in some previous RNA seq experiments I was able to confirm that the l pp mRNA is one of the most abundant mRNA in Nissle during exponential growth. | 740 |
| PapFAB46 | See, e.g., Kosuri, S., Goodman, D. B. & Cambray, G. Composability of regulatory sequences controlling transcription and translation in Escherichia coli. in 1-20 (2013). doi:10.1073/pnas. | 741 |
| PJ23101 + UP | UP element helps recruit RNA polymerase (ggaaaatttttttaaaaaaaaaac) | 742 |
| PJ23107 + UP | UP element helps recruit RNA polymerase (ggaaaatttttttaaaaaaaaaac) | 743 |
| PSYN23119 | UP element at 5' end; consensus -10 region is TATAAT; the consen sus -35 is TTGACA; the extended -10 region is generally TGNTATAAT (TGGTATAAT in this sequence) | 744 |

In some embodiments, the promoter is Plpp or a derivative thereof. In some embodiments, the promoter comprises a sequence from SEQ ID NO:740. In some embodiments, the constitutive promoter is at least about 80%, at least about 85%, at least about 90%, at least about 95%, or at least about 99% homologous to the sequence of SEQ ID NO: 740. In some embodiments, the promoter is PapFAB46 or a derivative thereof. In some embodiments, the promoter comprises a sequence from SEQ ID NO:741. In some embodiments, the constitutive promoter is at least about 80%, at least about 85%, at least about 90%, at least about 95%, or at least about 99% homologous to the sequence of SEQ ID NO: 741. In some embodiments, the promoter is PJ23101+UP element or a derivative thereof. In some embodiments, the promoter comprises a sequence from SEQ ID NO:742. In some embodiments, the constitutive promoter is at least about 80%, at least about 85%, at least about 90%, at least about 95%, or at least about 99% homologous to the sequence of SEQ ID NO: 742. In some embodiments, the promoter is PJ23107+UP element or a derivative thereof. In some embodiments, the promoter comprises a sequence from SEQ ID NO:743. In some embodiments, the constitutive promoter is at least about 80%, at least about 85%, at least about 90%, at least about 95%, or at least about 99% homologous to the sequence of SEQ ID NO: 743. In some embodiments, the promoter is PSYN23119 or a derivative thereof. In some embodiments, the promoter comprises a sequence from SEQ ID NO:744. In some embodiments, the constitutive promoter is at least about 80%, at least about 85%, at least about 90%, at least about 95%, or at least about 99% homologous to the sequence of SEQ ID NO: 744.

Ribosome Binding Sites

In some embodiments, ribosome binding sites are added, switched out or replaced. By testing a few ribosome binding sites, expression levels can be fine-tuned to the desired level. In some embodiments, RBS which are suitable for prokaryotic expression and can be used to achieve the desired expression levels are selected. Non-limiting examples of RBS are listed at Registry of standard biological parts. In some embodiments, the RBS is selected from BBa_J61100 (SEQ ID NO: 1019), BBa_J61101 (SEQ ID NO: 1020), BBa_J61102 (SEQ ID NO: 1021), BBa_J61103 (SEQ ID NO: 1022), BBa_J61104 (SEQ ID NO: 1023), BBa_J61105 (SEQ ID NO: 1024), BBa_J61106 (SEQ ID NO: 1025), BBa_J61107 (SEQ ID NO: 1026), BBa_J61108 (SEQ ID NO: 1027), BBa_J61109 (SEQ ID NO: 1028), BBa_J61110 (SEQ ID NO: 1029), BBa_J61111 (SEQ ID NO: 1030), BBa_J61112 (SEQ ID NO: 1031), BBa_J61113 (SEQ ID NO: 1032), BBa_J61114 (SEQ ID NO: 1033), BBa_J61115 (SEQ ID NO: 1034), BBa_J61116 (SEQ ID NO: 1035), BBa_J61117 (SEQ ID NO: 1036), BBa_J61118 (SEQ ID NO: 1037), BBa_J61119 (SEQ ID NO: 1038), BBa_J61120 (SEQ ID NO: 1039), BBa_J61121 (SEQ ID NO: 1040), BBa_J61122 (SEQ ID NO: 1041), BBa_J61123 (SEQ ID NO: 1042), BBa_J61124 (SEQ ID NO: 1043), BBa_J61125 (SEQ ID NO: 1044), BBa_J61126 (SEQ ID NO: 1045), BBa_J61127 (SEQ ID NO: 1046), BBa_J61128 (SEQ ID NO: 1047), BBa_J61129 (SEQ ID NO: 1048), BBa_J61130 (SEQ ID NO: 1049), BBa_J61131 (SEQ ID NO: 1050), BBa_J61132 (SEQ ID NO: 873), BBa_J61133 (SEQ ID NO: 869), BBa_J61134 (SEQ ID NO: 870), BBa_J61135 (SEQ ID NO: 871), BBa_J61136 (SEQ ID NO: 874), BBa_J61137 (SEQ ID NO: 875), BBa_J61138 (SEQ ID NO: 876), BBa_J61139 (SEQ ID NO: 877), BBa_B0029 (SEQ ID NO: 880), BBa_B0030 (SEQ ID NO: 881), BBa_B0031 (SEQ ID NO: 882), BBa_B0032 (SEQ ID NO: 883), BBa_B0033 (SEQ ID NO: 884), BBa_B0034 (SEQ ID NO: 885), BBa_B0035 (SEQ ID NO: 886), BBa_B0064 (SEQ ID NO: 887) or a derivative thereof.

In some embodiments, the constitutive promoter is at least about 80%, at least about 85%, at least about 90%, at least about 95%, or at least about 99% homologous to a sequence selected from SEQ ID NO: 1018-1050 and 869-871, 873-877, 880-887. In another embodiment, the promoter sequence comprises a sequence selected from SEQ ID NO: 1018-1050 and 869-871, 873-877, 880-887. In yet another embodiment, the promoter sequence consists of a sequence selected from SEQ ID NO: 1018-1050 and 869-871, 873-877, 880-887.

Induction of Payloads During Strain Culture

In some embodiments, it is desirable to pre-induce payload or protein of interest expression and/or payload activity prior to administration. Such payload or protein of interest may be an effector intended for secretion or may be an enzyme which catalyzes a metabolic reaction to produce an effector. In other embodiments, the protein of interest is an enzyme which catabolizes a harmful metabolite. In such situations, the strains are pre-loaded with active payload or protein of interest. In such instances, the genetically engineered bacteria of the invention express one or more protein(s) of interest, under conditions provided in bacterial culture during cell growth, expansion, purification, fermentation, and/or manufacture prior to administration in vivo. Such culture conditions can be provided in a flask, fermenter or other appropriate culture vessel, e.g., used during cell growth, cell expansion, fermentation, recovery, purification, formulation, and/or manufacture. As used herein, the term "bacterial culture" or bacterial cell culture" or "culture" refers to bacterial cells or microorganisms, which are maintained or grown in vitro during several production processes, including cell growth, cell expansion, recovery, purification, fermentation, and/or manufacture. As used herein, the term "fermentation" refers to the growth, expansion, and maintenance of bacteria under defined conditions. Fermentation may occur under a number of cell culture conditions, including anaerobic or low oxygen or oxygenated conditions, in the presence of inducers, nutrients, at defined temperatures, and the like.

Culture conditions are selected to achieve optimal activity and viability of the cells, while maintaining a high cell density (high biomass) yield. A number of cell culture conditions and operating parameters are monitored and adjusted to achieve optimal activity, high yield and high viability, including oxygen levels (e.g., low oxygen, microaerobic, aerobic), temperature of the medium, and nutrients and/or different growth media, chemical and/or nutritional inducers and other components provided in the medium.

In some embodiments, the one or more protein(s) of interest and are directly or indirectly induced, while the strains is grown up for in vivo administration. Without wishing to be bound by theory, pre-induction may boost in vivo activity. This is particularly important in proximal regions of the gut which are reached first by the bacteria, e.g., the small intestine. If the bacterial residence time in this compartment is relatively short, the bacteria may pass through the small intestine without reaching full in vivo induction capacity. In contrast, if a strain is pre-induced and preloaded, the strains are already fully active, allowing for greater activity more quickly as the bacteria reach the intestine. Ergo, no transit time is "wasted", in which the strain is not optimally active. As the bacteria continue to move through the intestine, in vivo induction occurs under environmental conditions of the gut (e.g., low oxygen, or in the presence of gut metabolites).

In one embodiment, expression of one or more payload(s), is induced during cell growth, cell expansion, fermentation, recovery, purification, formulation, and/or manufacture. In one embodiment, expression of several different proteins of interest is induced during cell growth, cell expansion, fermentation, recovery, purification, formulation, and/or manufacture. In one embodiment, expression of one or more payload(s), is driven from the same promoter as a multicistronic message. In one embodiment, expression of one or more payload(s) is driven from the same promoter as two or more separate messages. In one embodiment, expression of one or more payload(s) is driven from the one or more different promoters.

In some embodiments, the strains are administered without any pre-induction protocols during strain growth prior to in vivo administration.

Anaerobic Induction

In some embodiments, cells are induced under anaerobic or low oxygen conditions in culture. In such instances, cells are grown (e.g., for 1.5 to 3 hours) until they have reached a certain OD, e.g., ODs within the range of 0.1 to 10, indicating a certain density e.g., ranging from $1\times10^8$ to $1\times10^{11}$, and exponential growth and are then switched to anaerobic or low oxygen conditions for approximately 3 to 5 hours. In some embodiments, strains are induced under anaerobic or low oxygen conditions, e.g. to induce FNR promoter activity and drive expression of one or more payload(s) and/or transporters under the control of one or more FNR promoters.

In one embodiment, expression of one or more payload(s), is under the control of one or more FNR promoter(s) and is induced during cell growth, cell expansion, fermentation, recovery, purification, formulation, and/or manufacture under anaerobic or low oxygen conditions. In one embodiment, expression of several different proteins of interest is under the control of one or more FNR promoter(s) and is induced during cell growth, cell expansion, fermentation, recovery, purification, formulation, and/or manufacture under anaerobic or low oxygen conditions.

In one embodiment, expression of two or more payload(s), is under the control of one or more FNR promoter(s) and is driven from the same promoter in the form of a multicistronic message under anaerobic or low oxygen conditions. In one embodiment, expression of one or more payload(s), is under the control of one or more FNR promoter(s) and is driven from the same promoter as two or more separate messages under anaerobic or low oxygen conditions. In one embodiment, expression of one or more payload(s under the control of one or more FNR promoter(s) and is driven from the one or more different promoters under anaerobic or low oxygen conditions.

Without wishing to be bound by theory, strains that comprise one or more payload(s) under the control of an FNR promoter, may allow expression of payload(s) from these promoters in vitro, under anaerobic or low oxygen culture conditions, and in vivo, under the low oxygen conditions found in the gut and/or conditions of the tumor microenvironment.

In some embodiments, promoters inducible by arabinose, IPTG, rhamnose, tetracycline, and/or other chemical and/or nutritional inducers can be induced under anaerobic or low oxygen conditions in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) under the control of one or more FNR promoter(s) and one or more payload gene sequence(s) and/or transporter gene sequence(s) and/or transcriptional regulator gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) and/or under the control of one or more FNR promoter(s), and one or more payload gene sequence(s) under the control of a one or more constitutive promoter(s) described herein. In some embodiments, strains may comprise one or more payload gene sequence(s) under the control of an FNR promoter and one or more payload gene sequence(s) under the control of a one or more thermoregulated promoter(s) described herein.

In one embodiment, expression of one or more Payload is under the control of one or more promoter(s) regulated by chemical and/or nutritional inducers and is induced during cell growth, cell expansion, fermentation, recovery, purification, formulation, and/or manufacture under anaerobic and/or low oxygen conditions. In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In one embodiment, expression of one or more payload(s), is under the control of one or more promoter(s) regulated by chemical and/or nutritional inducers and is driven from the same promoter in the form of a multicistronic message under anaerobic and/or low oxygen conditions. In one embodiment, expression of one or more payload(s), is under the control of one or more promoter(s) regulated by chemical and/or nutritional inducers and is driven from the same promoter as two or more separate messages under anaerobic and/or low oxygen conditions. In one embodiment, expression of one or more payload(s), is under the control of one or more promoter(s) regulated by chemical and/or nutritional inducers and is driven from the one or more different promoters under anaerobic and/or low oxygen conditions.

In one embodiment, strains may comprise a combination of gene sequence(s), some of which are under control of a first inducible promoter and others which are under control of a second inducible promoter, both induced by chemical and/or nutritional inducers, under anaerobic or low oxygen conditions. In one embodiment, strains may comprise a combination of gene sequence(s), some of which are under control of a first inducible promoter and others which are under control of a second inducible promoter, both induced by chemical and/or nutritional inducers. In some embodiments, the strains comprise gene sequence(s) under the control of a third inducible promoter, e.g., an anaerobic/low oxygen promoter, e.g., FNR promoter. In one embodiment, strains may comprise a combination of gene sequence(s), some of which are under control of a first inducible promoter, e.g., a chemically induced promoter or a low oxygen promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) and/or transporter gene sequence(s) and/or transcriptional regulator gene sequence(s) under the control of an FNR promoter and one or more payload gene sequence(s) and/or transporter gene sequence(s) and/or transcriptional regulator gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload and or transporter sequence(s) under the control of one or more constitutive promoter(s) active under low oxygen conditions.

Aerobic Induction

In some embodiments, it is desirable to prepare, pre-load and pre-induce the strains under aerobic conditions. This allows more efficient growth and viability, and, in some cases, reduces the build-up of toxic metabolites. In such instances, cells are grown (e.g., for 1.5 to 3 hours) until they have reached a certain OD, e.g., ODs within the range of 0.1 to 10, indicating a certain density e.g., ranging from $1 \times 10^{\wedge}8$ to $1 \times 10^{\wedge}11$, and exponential growth and are then induced through the addition of the inducer or through other means, such as shift to a permissive temperature, for approximately 3 to 5 hours.

In some embodiments, promoters inducible by arabinose, IPTG, rhamnose, tetracycline, and/or other chemical and/or nutritional inducers described herein or known in the art can be induced under aerobic conditions in the presence of the chemical and/or nutritional inducer during cell growth, cell expansion, fermentation, recovery, purification, formulation, and/or manufacture. In one embodiment, expression of one or more payload(s) is under the control of one or more promoter(s) regulated by chemical and/or nutritional inducers and is induced during cell growth, cell expansion, fermentation, recovery, purification, formulation, and/or manufacture under aerobic conditions.

In one embodiment, expression of one or more payload(s), is under the control of one or more promoter(s) regulated by chemical and/or nutritional inducers and is driven from the same promoter in the form of a multicistronic message under aerobic conditions. In one embodiment, expression of one or more payload(s), is under the control of one or more promoter(s) regulated by chemical and/or nutritional inducers and is driven from the same promoter as two or more separate messages under aerobic conditions. In one embodiment, expression of one or more payload(s), is under the control of one or more promoter(s) regulated by chemical and/or nutritional inducers and is driven from the one or more different promoters under aerobic conditions.

In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In some embodiments, promoters regulated by temperature are induced during cell growth, cell expansion, fermentation, recovery, purification, formulation, and/or manufacture. In one embodiment, expression of one or more payload(s) is driven directly or indirectly by one or more thermoregulated promoter(s) and is induced during cell growth, cell expansion, fermentation, recovery, purification, formulation, and/or manufacture under aerobic conditions.

In one embodiment, expression of one or more payload(s) is driven directly or indirectly by one or more thermoregulated promoter(s) and is driven from the same promoter in the form of a multicistronic message under aerobic conditions. In one embodiment, expression of one or more payload(s) is driven directly or indirectly by one or more thermoregulated promoter(s) and is driven from the same promoter as two or more separate messages under aerobic conditions. In one embodiment, expression of one or more payload(s) is driven directly or indirectly by one or more thermoregulated promoter(s) and is driven from the one or more different promoters under aerobic conditions.

In one embodiment, strains may comprise a combination of gene sequence(s), some of which are under control of a first inducible promoter and others which are under control of a second inducible promoter, both induced under aerobic conditions. In some embodiments, a strain comprises three or more different promoters which are induced under aerobic culture conditions.

In one embodiment, strains may comprise a combination of gene sequence(s), some of which are under control of a first inducible promoter and others which are under control of a second inducible promoter, both induced by chemical and/or nutritional inducers. In one embodiment, strains may comprise a combination of gene sequence(s), some of which are under control of a first inducible promoter, e.g. a chemically inducible promoter, and others which are under control of a second inducible promoter, e.g. a temperature sensitive promoter under aerobic culture conditions. In some embodiments two or more chemically induced promoter gene sequence(s) are combined with a thermoregulated construct described herein. In one embodiment, the chemical and/or nutritional inducer is arabinose and the promoter is inducible by arabinose. In one embodiment, the chemical and/or nutritional inducer is IPTG and the promoter is inducible by IPTG. In one embodiment, the chemical and/or nutritional inducer is rhamnose and the promoter is inducible by rhamnose. In one embodiment, the chemical and/or nutritional inducer is tetracycline and the promoter is inducible by tetracycline.

In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) and/or Transporter gene sequence(s) and/or transcriptional regulator gene sequence(s) under the control of an FNR promoter and one or more payload gene sequence(s) and/or Transporter gene sequence(s) and/or transcriptional regulator gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload and or Transporter sequence(s) under the control of one or more constitutive promoter(s) active under aerobic conditions.

In some embodiments, genetically engineered strains comprise gene sequence(s) which are induced under aerobic culture conditions. In some embodiments, these strains further comprise FNR inducible gene sequence(s) for in vivo activation in the gut and/or conditions of the tumor microenvironment. In some embodiments, these strains do not further comprise FNR inducible gene sequence(s) for in vivo activation in the gut and/or conditions of the tumor microenvironment.

In some embodiments, genetically engineered strains comprise gene sequence(s), which are arabinose inducible under aerobic culture conditions. In some embodiments, these strains do not further comprise FNR inducible gene sequence(s) for in vivo activation in the gut and/or conditions of the tumor microenvironment.

In some embodiments, genetically engineered strains comprise gene sequence(s), which are IPTG inducible under aerobic culture conditions. In some embodiments, these strains further comprise FNR inducible gene sequence(s) for in vivo activation in the gut and/or conditions of the tumor microenvironment. In some embodiments, these strains do not further comprise FNR inducible gene sequence(s) for in vivo activation in the gut and/or conditions of the tumor microenvironment.

In some embodiments, genetically engineered strains comprise gene sequence(s) which are arabinose inducible under aerobic culture conditions. In some embodiments, such a strain further comprises sequence(s) which are IPTG inducible under aerobic culture conditions. In some embodiments, these strains further comprise FNR inducible gene payload and/or Transporter sequence(s) for in vivo activation in the gut and/or conditions of the tumor microenvironment. In some embodiments, these strains do not further comprise FNR inducible gene sequence(s) for in vivo activation in the gut and/or conditions of the tumor microenvironment.

As evident from the above non-limiting examples, genetically engineered strains comprise inducible gene sequence(s) which can be induced numerous combinations. For example, rhamnose or tetracycline can be used as an inducer with the appropriate promoters in addition or in lieu of arabinose and/or IPTG or with thermoregulation. Additionally, such bacterial strains can also be induced with the chemical and/or nutritional inducers under anaerobic conditions.

Microaerobic Induction

In some embodiments, viability, growth, and activity are optimized by pre-inducing the bacterial strain under microaerobic conditions. In some embodiments, microaerobic conditions are best suited to "strike a balance" between optimal growth, activity and viability conditions and optimal conditions for induction; in particular, if the expression of the one or more payload(s) and/or Transporter(s) are driven by an anaerobic and/or low oxygen promoter, e.g., a FNR promoter. In such instances, cells are grown (e.g., for 1.5 to 3 hours) until they have reached a certain OD, e.g., ODs within the range of 0.1 to 10, indicating a certain density e.g., ranging from $1\times10^8$ to $1\times10^{11}$, and exponential growth and are then induced through the addition of the inducer or through other means, such as shift to at a permissive temperature, for approximately 3 to 5 hours.

In one embodiment, expression of one or more payload(s) is under the control of one or more FNR promoter(s) and is induced during cell growth, cell expansion, fermentation, recovery, purification, formulation, and/or manufacture under microaerobic conditions.

In one embodiment, expression of one or more payload(s), is under the control of one or more FNR promoter(s) and is driven from the same promoter in the form of a multicistronic message under microaerobic conditions. In one embodiment, expression of one or more payload(s), is under the control of one or more FNR promoter(s) and is driven from the same promoter as two or more separate messages under microaerobic conditions. In one embodiment, expression of one or more payload(s), is under the control of one or more FNR promoter(s) and is driven from the one or more different promoters under microaerobic conditions.

Without wishing to be bound by theory, strains that comprise one or more payload(s) under the control of an FNR promoter, may allow expression of payload(s) from these promoters in vitro, under microaerobic culture conditions, and in vivo, under the low oxygen conditions found in the gut and/or conditions of the tumor microenvironment.

In some embodiments, promoters inducible by arabinose, IPTG, rhamnose, tetracycline, and/or other chemical and/or nutritional inducers can be induced under microaerobic conditions in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) sequence(s) under the control of one or more FNR promoter(s) and one or more payload gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) under the control of one or more FNR promoter(s), and one or more payload gene sequence(s) under the control of a one or more constitutive promoter(s) described herein. In some embodiments, strains may comprise one or more payload gene sequence(s) under the control of an FNR promoter and one or more payload gene sequence(s) under the control of a one or more thermoregulated promoter(s) described herein.

In one embodiment, expression of one or more payload(s) is under the control of one or more promoter(s) regulated by chemical and/or nutritional inducers and is induced during cell growth, cell expansion, fermentation, recovery, purification, formulation, and/or manufacture under microaerobic conditions.

In one embodiment, expression of one or more payload(s), is under the control of one or more promoter(s) regulated by chemical and/or nutritional inducers and is driven from the same promoter in the form of a multicistronic message under microaerobic conditions. In one embodiment, expression of one or more payload(s), is under the control of one or more promoter(s) regulated by chemical and/or nutritional inducers and is driven from the same promoter as two or more separate messages under microaerobic conditions. In one embodiment, expression of one or more payload(s), is under the control of one or more promoter(s) regulated by chemical and/or nutritional inducers and is driven from the one or more different promoters under microaerobic conditions.

In one embodiment, strains may comprise a combination of gene sequence(s), some of which are under control of a first inducible promoter and others which are under control of a second inducible promoter, both induced by chemical and/or nutritional inducers, under microaerobic conditions. In one embodiment, strains may comprise a combination of gene sequence(s), some of which are under control of a first inducible promoter and others which are under control of a second inducible promoter, both induced by chemical and/or nutritional inducers. In some embodiments, the strains comprise gene sequence(s) under the control of a third inducible promoter, e.g., an anaerobic/low oxygen promoter or microaerobic promoter, e.g., FNR promoter. In one embodiment, strains may comprise a combination of gene sequence(s), some of which are under control of a first inducible promoter, e.g., a chemically induced promoter or a low oxygen or microaerobic promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) under the control of an FNR promoter and one or more payload gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload under the control of one or more constitutive promoter(s) active under low oxygen conditions.

Induction of Strains Using Phasing, Pulsing and/or Cycling

In some embodiments, cycling, phasing, or pulsing techniques are employed during cell growth, expansion, recovery, purification, fermentation, and/or manufacture to efficiently induce and grow the strains prior to in vivo administration. This method is used to "strike a balance" between optimal growth, activity, cell health, and viability conditions and optimal conditions for induction; in particular, if growth, cell health or viability are negatively affected under inducing conditions. In such instances, cells are grown (e.g., for 1.5 to 3 hours) in a first phase or cycle until they have reached a certain OD, e.g., ODs within the range of 0.1 to 10, indicating a certain density e.g., ranging from $1\times10^8$ to $1\times10^{11}$, and are then induced through the addition of the inducer or through other means, such as shift to a permissive temperature (if a promoter is thermoregulated), or change in oxygen levels (e.g., reduction of oxygen level in the case of induction of an FNR promoter driven construct) for approximately 3 to 5 hours. In a second phase or cycle, conditions are brought back to the original conditions which support optimal growth, cell health and viability. Alternatively, if a chemical and/or nutritional inducer is used, then the culture can be spiked with a second dose of the inducer in the second phase or cycle.

In some embodiments, two cycles of optimal conditions and inducing conditions are employed (i.e., growth, induction, recovery and growth, induction). In some embodiments, three cycles of optimal conditions and inducing conditions are employed. In some embodiments, four or more cycles of optimal conditions and inducing conditions are employed. In a non-liming example, such cycling and/or phasing is used for induction under anaerobic and/or low oxygen conditions (e.g., induction of FNR promoters). In one embodiment, cells are grown to the optimal density and then induced under anaerobic and/or low oxygen conditions. Before growth and/or viability are negatively impacted due to stressful induction conditions, cells are returned to oxygenated conditions to recover, after which they are then returned to inducing anaerobic and/or low oxygen conditions for a second time. In some embodiments, these cycles are repeated as needed.

In some embodiments, growing cultures are spiked once with the chemical and/or nutritional inducer. In some embodiments, growing cultures are spiked twice with the chemical and/or nutritional inducer. In some embodiments, growing cultures are spiked three or more times with the chemical and/or nutritional inducer. In a non-limiting example, cells are first grown under optimal growth conditions up to a certain density, e.g., for 1.5 to 3 hour) to reach an of 0.1 to 10, until the cells are at a density ranging from $1\times10^8$ to $1\times10^{11}$. Then the chemical inducer, e.g., arabinose or IPTG, is added to the culture. After 3 to 5 hours, an additional dose of the inducer is added to re-initiate the induction. Spiking can be repeated as needed.

In some embodiments, phasing or cycling changes in temperature in the culture. In another embodiment, adjustment of temperature may be used to improve the activity of a payload. For example, lowering the temperature during culture may improve the proper folding of the payload. In such instances, cells are first grown at a temperature optimal for growth (e.g., 37 C). In some embodiments, the cells are then induced, e.g., by a chemical inducer, to express the payload. Concurrently or after a set amount of induction time, the temperature in the media is lowered, e.g., between 25 and 35 C, to allow improved folding of the expressed payload.

In some embodiments, payload(s) are under the control of different inducible promoters, for example two different chemical inducers. In other embodiments, the payload is induced under low oxygen conditions or microaerobic conditions and a second payload is induced by a chemical inducer.

In one embodiment, expression of one or more payload(s) is under the control of one or more FNR promoter(s) and is induced during cell growth, cell expansion, fermentation, recovery, purification, formulation, and/or manufacture by using phasing or cycling or pulsing or spiking techniques.

In one embodiment, expression of one or more payload(s), is under the control of one or more FNR promoter(s) and is driven from the same promoter in the form of a multicistronic message through the employment of phasing or cycling or pulsing or spiking techniques. In one embodiment, expression of one or more payload(s), is under the control of one or more FNR promoter(s) and is driven from the same promoter as two or more separate messages through the employment of phasing or cycling or pulsing or spiking techniques. In one embodiment, expression of one or more payload(s), is under the control of one or more FNR promoter(s) and is driven from the one or more different promoters through the employment of phasing or cycling or pulsing or spiking techniques.

In some embodiments, promoters inducible by arabinose, IPTG, rhamnose, tetracycline, and/or other chemical and/or nutritional inducers can be induced through the employment of phasing or cycling or pulsing or spiking techniques in the presence of the chemical and/or nutritional inducer. In particular, strains may comprise a combination of gene sequence(s), some of which are under control of FNR promoters and others which are under control of promoters induced by chemical and/or nutritional inducers. In some embodiments, strains may comprise one or more payload gene sequence(s) under the control of one or more FNR promoter(s) and one or more payload gene sequence(s) under the control of a one or more promoter(s) which are induced by a one or more chemical and/or nutritional inducer(s), including, but not limited to, arabinose, IPTG, rhamnose, tetracycline, and/or other chemical and/or nutritional inducers described herein or known in the art. In some embodiments, strains may comprise one or more payload gene sequence(s) under the control of one or more FNR promoter(s), and one or more payload gene sequence(s) and/or Transporter gene sequence(s) and/or transcriptional regulator gene sequence(s) under the control of a one or more constitutive promoter(s) described herein and are induced through the employment of phasing or cycling or pulsing or spiking techniques. In some embodiments, strains may comprise one or more payload gene sequence(s) under the control of an FNR promoter and one or more payload gene sequence(s) under the control of a one or more thermoregulated promoter(s) described herein, and are induced through the employment of phasing or cycling or pulsing or spiking techniques.

Any of the strains described herein can be grown through the employment of phasing or cycling or pulsing or spiking techniques. In one embodiment, expression of one or more payload(s) is under the control of one or more promoter(s) regulated by chemical and/or nutritional inducers and is induced during cell growth, cell expansion, fermentation, recovery, purification, formulation, and/or manufacture under anaerobic and/or low oxygen conditions.

In one embodiment, expression of one or more payload(s), is under the control of one or more promoter(s) regulated by chemical and/or nutritional inducers and is driven from the same promoter in the form of a multicistronic message and which are induced through the employment of phasing or cycling or pulsing or spiking techniques. In one embodiment, expression of one or more payload(s), is under the control of one or more promoter(s) regulated by chemical and/or nutritional inducers and is driven from the same promoter as two or more separate messages and is grown through the employment of phasing or cycling or pulsing or spiking techniques. In one embodiment, expression of one or more payload(s), is under the control of one or more promoter(s) regulated by chemical and/or nutritional inducers and is driven from the one or more different promoters, all of which are induced through the employment of phasing or cycling or pulsing or spiking techniques.

In one embodiment, strains may comprise a combination of gene sequence(s), some of which are under control of a first inducible promoter and others which are under control of a second inducible promoter, both induced by chemical and/or nutritional inducers, through the employment of phasing or cycling or pulsing or spiking techniques. In one embodiment, strains may comprise a combination of gene sequence(s), some of which are under control of a first inducible promoter and others which are under control of a second inducible promoter, both induced by chemical and/or nutritional inducers through the employment of phasing or cycling or pulsing or spiking techniques. In some embodiments, the strains comprise gene sequence(s) under the control of a third inducible promoter, e.g., an anaerobic/low oxygen promoter, e.g., FNR promoter. In one embodiment, strains may comprise a combination of gene sequence(s), some of which are under control of a first inducible promoter, e.g., a chemically induced promoter or a low oxygen promoter and others which are under control of a second inducible promoter, e.g. a temperature sensitive promoter. In one embodiment, strains may comprise a combination of gene sequence(s), some of which are under control of a first inducible promoter, e.g., a FNR promoter and others which are under control of a second inducible promoter, e.g. a temperature sensitive promoter. In one embodiment, strains may comprise a combination of gene sequence(s), some of which are under control of a first inducible promoter, e.g., a chemically induced and others which are under control of a second inducible promoter, e.g. a temperature sensitive promoter. In some embodiments, strains may comprise one or more payload gene sequence(s) under the control of an FNR promoter and one or more payload gene sequence(s) under the control of a one or more promoter(s) which are induced by a one or more chemical and/or nutritional inducer(s), including, but not limited to, by arabinose, IPTG, rhamnose, tetracycline, and/or other chemical and/or nutritional inducers described herein or known in the art. Additionally the strains may comprise a construct which is under thermoregulatory control. In some embodiments, the bacteria strains further comprise payload sequence(s) under the control of one or more constitutive promoter(s) active under low oxygen conditions. Any of the strains described in these embodiments may be induced through the employment of phasing or cycling or pulsing or spiking techniques.

Generation of Bacterial Strains with Enhance Ability to Transport Biomolecules

Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing an amino acid is disrupted a strain capable of high-affinity capture of said amino acid can be evolved via ALE. First, the strain is grown in varying concentrations of the auxotrophic amino acid, until a minimum concentration to support growth is established. The strain is then passaged at that concentration, and diluted into lowering concentrations of the amino acid at regular intervals. Over time, cells that are most competitive for the amino acid—at growth-limiting concentrations—will come to dominate the population. These strains will likely have mutations in their amino acid-transporters resulting in increased ability to import the essential and limiting amino acid.

Similarly, by using an auxotroph that cannot use an upstream metabolite to form an amino acid, a strain can be evolved that not only can more efficiently import the upstream metabolite, but also convert the metabolite into the essential downstream metabolite. These strains will also evolve mutations to increase import of the upstream metabolite, but may also contain mutations which increase expression or reaction kinetics of downstream enzymes, or that reduce competitive substrate utilization pathways.

In the previous examples, a metabolite innate to the microbe was made essential via mutational auxotrophy and selection was applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate. Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased, and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about $10^{11.2}$ CCD[1]. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

These methods were used to generate *E. coli* Nissle mutants that consume kynurenine and over-produce tryptophan as described elsewhere herein.

Nucleic Acids

In some embodiments, the disclosure provides novel nucleic acids for consuming adenosine. In some embodiments, the nucleic acid comprises gene sequence encoding one or more adenosine consuming enzyme(s). In some embodiments, the nucleic acid comprises gene sequence encoding Add. In some embodiments, the nucleic acid comprises gene sequence encoding XapA. In some embodiments, the nucleic acid comprises gene sequence encoding DeoD. In some embodiments, the nucleic acid comprises gene sequence encoding XdhA. In some embodiments, the nucleic acid comprises gene sequence encoding XdhB. In some embodiments, the nucleic acid comprises gene sequence encoding XdhC. In some embodiments, the nucleic acid comprises gene sequence encoding NupC. In some embodiments, the nucleic acid comprises gene sequence encoding NupG.

In some embodiments, the nucleic acid comprises gene sequence selected from xapA, deoD, xdhA, xdhB, xdhC, nupC and any combinations thereof. In some embodiments, the nucleic acid comprises gene sequence selected from xapA, deoD, xdhA, xdhB, xdhC, nupG and any combinations thereof.

In some embodiments, the nucleic acid sequence comprising gene sequence selected from xapA, deoD, xdhA, xdhB, xdhC, nupC and any combinations thereof further comprises a nucleic acid sequence encoding antiCD40 antibody.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises nupC. Accordingly, in one embodiment, the nucleic acid sequence comprising the nupC gene has at least about 80% identity with SEQ ID NO: 71. In one embodiment, the nucleic acid sequence comprising the nupC gene has at least about 90% identity with SEQ ID NO: 71. In another embodiment, the nucleic acid sequence comprising the nupC gene has at least about 95% identity with SEQ ID NO: 71. Accordingly, in one embodiment, the nucleic acid sequence comprising the nupC gene has at least about 85%, 86%, 87%, 88%, 89%, 90%, 91%, 92%, 93%, 94%, 95%, 96%, 97%, 98%, or 99% identity with SEQ ID NO: 71. In another embodiment, the nucleic acid sequence comprising the nupC gene comprises SEQ ID NO: 71. In yet another embodiment, the nucleic acid sequence comprising the nupC gene consists of SEQ ID NO: 71.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhA. Accordingly, in one embodiment, the nucleic acid sequence comprising the xdhA gene has at least about 80% identity with SEQ ID NO: 72. In one embodiment, the nucleic acid sequence comprising the xdhA gene has at least about 90% identity with SEQ ID NO: 72. In another embodiment, the nucleic acid sequence comprising the xdhA gene has at least about 95% identity with SEQ ID NO: 72. Accordingly, in one embodiment, the nucleic acid sequence comprising the xdhA gene has at least about 85%, 86%, 87%, 88%, 89%, 90%, 91%, 92%, 93%, 94%, 95%, 96%, 97%, 98%, or 99% identity with SEQ ID NO: 72. In another embodiment, the nucleic acid sequence comprising the xdhA gene comprises SEQ ID NO: 72. In yet another embodiment, the nucleic acid sequence comprising the xdhA gene consists of SEQ ID NO: 72.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhB. Accordingly, in one embodiment, the nucleic acid sequence comprising the xdhB gene has at least about 80% identity with SEQ ID NO: 73. In one embodiment, the nucleic acid sequence comprising the xdhB gene has at least about 90% identity with SEQ ID NO: 73. In another embodiment, the nucleic acid sequence comprising the xdhB gene has at least about 95% identity with SEQ ID NO: 73. Accordingly, in one embodiment, the nucleic acid sequence comprising the xdhB gene has at least about 85%, 86%, 87%, 88%, 89%, 90%, 91%, 92%, 93%, 94%, 95%, 96%, 97%, 98%, or 99% identity with SEQ ID NO: 73. In another embodiment, the nucleic acid sequence comprising the xdhB gene comprises SEQ ID NO: 73. In yet another embodiment, the nucleic acid sequence comprising the xdhB gene consists of SEQ ID NO: 73.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xdhC. Accordingly, in one embodiment, the nucleic acid sequence comprising the xdhC gene has at least about 80% identity with SEQ ID NO: 74. In one embodiment, the nucleic acid sequence comprising the xdhC gene has at least about 90% identity with SEQ ID NO: 74. In another embodiment, the nucleic acid sequence comprising the xdhC gene has at least about 95% identity with SEQ ID NO: 74. Accordingly, in one embodiment, the nucleic acid sequence comprising the xdhC gene has at least about 85%, 86%, 87%, 88%, 89%, 90%, 91%, 92%, 93%, 94%, 95%, 96%, 97%, 98%, or 99% identity with SEQ ID NO: 74. In another embodiment, the nucleic acid sequence comprising the xdhC gene comprises SEQ ID NO: 74. In yet another embodiment, the nucleic acid sequence comprising the xdhC gene consists of SEQ ID NO: 74.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises Add. Accordingly, in one embodiment, the nucleic acid sequence comprising the Add gene has at least about 80% identity with SEQ ID NO: 75. In one embodiment, the nucleic acid sequence comprising the Add gene has at least about 90% identity with SEQ ID NO: 75. In another embodiment, the nucleic acid sequence comprising the Add gene has at least about 95% identity with SEQ ID NO: 75. Accordingly, in one embodiment, the nucleic acid sequence comprising the Add gene has at least about 85%, 86%, 87%, 88%, 89%, 90%, 91%, 92%, 93%, 94%, 95%, 96%, 97%, 98%, or 99% identity with SEQ ID NO: 75. In another embodiment, the nucleic acid sequence comprising the Add gene comprises SEQ ID NO: 75. In yet another embodiment, the nucleic acid sequence comprising the Add gene consists of SEQ ID NO: 75.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises xapA. Accordingly, in one embodiment, the nucleic acid sequence comprising the xapA gene has at least about 80% identity with SEQ ID NO: 76. In one embodiment, the nucleic acid sequence comprising the xapA gene has at least about 90% identity with SEQ ID NO: 76. In another embodiment, the nucleic acid sequence comprising the xapA gene has at least about 95% identity with SEQ ID NO: 76. Accordingly, in one embodiment, the nucleic acid sequence comprising the xapA gene has at least about 85%, 86%, 87%, 88%, 89%, 90%, 91%, 92%, 93%, 94%, 95%, 96%, 97%, 98%, or 99% identity with SEQ ID NO: 76. In another embodiment, the nucleic acid sequence comprising the xapA gene comprises SEQ ID NO: 76. In yet another embodiment, the nucleic acid sequence comprising the xapA gene consists of SEQ ID NO: 76.

In some embodiments, the disclosure provides novel nucleic acids for degrading or depleting adenosine from the tumor microenvironment. In some embodiments, the nucleic acid comprises gene sequence encoding one or more adenosine catabolism enzyme(s). In one of the nucleic acid embodiments described herein, the nucleic acid sequence encoding the adenosine degrading enzyme comprises deoD. Accordingly, in one embodiment, the nucleic acid sequence comprising the deoD gene has at least about 80% identity with SEQ ID NO: 77. In one embodiment, the nucleic acid sequence comprising the deoD gene has at least about 90% identity with SEQ ID NO: 77. In another embodiment, the nucleic acid sequence comprising the deoD gene has at least about 95% identity with SEQ ID NO: 77. Accordingly, in one embodiment, the nucleic acid sequence comprising the deoD gene has at least about 85%, 86%, 87%, 88%, 89%, 90%, 91%, 92%, 93%, 94%, 95%, 96%, 97%, 98%, or 99% identity with SEQ ID NO: 77. In another embodiment, the nucleic acid sequence comprising the deoD gene comprises SEQ ID NO: 77. In yet another embodiment, the nucleic acid sequence comprising the deoD gene consists of SEQ ID NO: 77.

In one of the nucleic acid embodiments described herein, the adenosine catabolism enzyme comprises NupC. In one embodiment, the nucleic acid sequence encodes a polypeptide, which has at least about 80% identity with SEQ ID NO: 78. In one embodiment, the nucleic acid sequence encodes a polypeptide, which has at least about 90% identity with SEQ ID NO: 78. In another embodiment, the nucleic acid sequence encodes a polypeptide, which has at least about 95% identity with SEQ ID NO: 78. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 78. In another embodiment, the nucleic acid sequence encodes a polypeptide, which comprises a sequence which encodes SEQ ID NO: 78. In yet another embodiment, the nucleic acid sequence encodes a polypeptide, which consists of SEQ ID NO: 78.

In one of the nucleic acid embodiments described herein, the adenosine catabolism enzyme comprises XdhA. In one embodiment, the nucleic acid sequence encodes a polypeptide, which has at least about 80% identity with SEQ ID NO: 79. In one embodiment, the nucleic acid sequence encodes a polypeptide, which has at least about 90% identity with SEQ ID NO: 79. In another embodiment, the nucleic acid sequence encodes a polypeptide, which has at least about 95% identity with SEQ ID NO: 79. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 79. In another embodiment, the nucleic acid sequence encodes a polypeptide, which comprises a sequence which encodes SEQ ID NO: 79. In yet another embodiment, the nucleic acid sequence encodes a polypeptide, which consists of a sequence which encodes SEQ ID NO: 79.

In one of the nucleic acid embodiments described herein, the adenosine catabolism enzyme comprises XdhB. In one embodiment, the nucleic acid sequence encodes a polypeptide, which has at least about 80% identity with SEQ ID NO: 80. In one embodiment, the nucleic acid sequence encodes a polypeptide, which has at least about 90% identity with SEQ ID NO: 80. In another embodiment, the nucleic acid sequence encodes a polypeptide, which has at least about 95% identity with SEQ ID NO: 80. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 80. In another embodiment, the nucleic acid sequence encodes a polypeptide, which comprises a sequence which encodes SEQ ID NO: 80. In yet another embodiment, the nucleic acid sequence encodes a polypeptide, which consists of a sequence which encodes SEQ ID NO: 80.

In one of the nucleic acid embodiments described herein, the adenosine catabolism enzyme comprises XdhC. In one embodiment, the nucleic acid sequence encodes a polypeptide, which has at least about 80% identity with SEQ ID NO: 81. In one embodiment, the nucleic acid sequence encodes a polypeptide, which has at least about 90% identity with SEQ ID NO: 81. In another embodiment, the nucleic acid sequence encodes a polypeptide, which has at least about 95% identity with SEQ ID NO: 81. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 81. In another embodiment, the nucleic acid sequence encodes a polypeptide, which comprises a sequence which encodes SEQ ID NO: 81. In yet another embodiment, the nucleic acid sequence encodes a polypeptide, which consists of a sequence which encodes SEQ ID NO: 81.

In one of the nucleic acid embodiments described herein, the adenosine catabolism enzyme comprises Add. In one embodiment, the nucleic acid sequence encodes a polypeptide, which has at least about 80% identity with SEQ ID NO: 82. In one embodiment, the nucleic acid sequence encodes a polypeptide, which has at least about 90% identity with SEQ ID NO: 82. In another embodiment, the nucleic acid sequence encodes a polypeptide, which has at least about 95% identity with SEQ ID NO: 82. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 82. In another embodiment, the nucleic acid sequence encodes a polypeptide, which comprises a sequence which encodes SEQ ID NO: 82. In yet another embodiment, the nucleic acid sequence encodes a polypeptide, which consists of a sequence which encodes SEQ ID NO: 82.

In one of the nucleic acid embodiments described herein, the adenosine catabolism enzyme comprises XapA. In one embodiment, the nucleic acid sequence encodes a polypeptide, which has at least about 80% identity with SEQ ID NO: 83. In one embodiment, the nucleic acid sequence encodes a polypeptide, which has at least about 90% identity with SEQ ID NO: 83. In another embodiment, the nucleic acid sequence encodes a polypeptide, which has at least about 95% identity with SEQ ID NO: 83. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 83. In another embodiment, the nucleic acid sequence encodes a polypeptide, which comprises a sequence which encodes SEQ ID NO: 83. In yet another embodiment, the nucleic acid sequence encodes a polypeptide, which consists of a sequence which encodes SEQ ID NO: 83.

In one of the nucleic acid embodiments described herein, the adenosine catabolism enzyme comprises DeoD. In one embodiment, the nucleic acid sequence encodes a polypeptide, which has at least about 80% identity with SEQ ID NO: 84. In one embodiment, the nucleic acid sequence encodes a polypeptide, which has at least about 90% identity with SEQ ID NO: 84. In another embodiment, the nucleic acid sequence encodes a polypeptide, which has at least about 95% identity with SEQ ID NO: 84. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 84. In another embodiment, the nucleic acid sequence encodes a polypeptide, which comprises a sequence which encodes SEQ ID NO: 84. In yet another embodiment, the nucleic acid sequence encodes a polypeptide, which consists of a sequence which encodes SEQ ID NO: 84.

In some embodiments, the disclosure provides novel nucleic acids for catabolizing adenosine. In some embodiments, the nucleic acid comprises gene sequence encoding one or more adenosine catabolism enzyme cassette(s). In one of the nucleic acid embodiments described herein, the nucleic acid sequence encoding the adenosine degrading enzyme cassette comprises a nucleic acid sequence comprising xdhABC. Accordingly, in one embodiment, nucleic acid sequence comprising xdhABC has at least about 80% identity with SEQ ID NO: 857. In one embodiment, the nucleic acid sequence comprising xdhABC has at least about 90% identity with SEQ ID NO: 857. In one embodiment, the nucleic acid sequence comprising xdhABC has at least about 95% identity with SEQ ID NO: 857. In one embodiment, the nucleic acid sequence comprising xdhABC has at least about 85%, 86%, 87%, 88%, 89%, 90%, 91%, 92%, 93%, 94%, 95%, 96%, 97%, 98%, or 99% identity with SEQ ID NO: 857. In another embodiment, the nucleic acid sequence comprising xdhABC comprises the sequence of SEQ ID NO: 857. In another embodiment, the nucleic acid sequence comprising xdhABC consists of the sequence of SEQ ID NO: 857.

In some embodiments, the disclosure provides novel nucleic acids for catabolizing adenosine. In some embodiments, the nucleic acid comprises gene sequence encoding one or more adenosine catabolism enzyme cassette(s). In one of the nucleic acid embodiments described herein, the nucleic acid sequence encoding the adenosine degrading enzyme cassette comprises a nucleic acid sequence comprising add-xapA-deoD. Accordingly, in one embodiment, nucleic acid sequence comprising add-xapA-deoD has at least about 80% identity with SEQ ID NO: 861. In one embodiment, the nucleic acid sequence comprising add-xapA-deoD has at least about 90% identity with SEQ ID NO: 861. In one embodiment, the nucleic acid sequence comprising add-xapA-deoD has at least about 95% identity with SEQ ID NO: 861. In one embodiment, the nucleic acid sequence comprising add-xapA-deoD has at least about 85%, 86%, 87%, 88%, 89%, 90%, 91%, 92%, 93%, 94%, 95%, 96%, 97%, 98%, or 99% identity with SEQ ID NO: 861. In another embodiment, the nucleic acid sequence comprising add-xapA-deoD comprises the sequence of SEQ ID NO: 861. In another embodiment, the nucleic acid sequence comprising add-xapA-deoD consists of the sequence of SEQ ID NO: 861.

In some embodiments, the disclosure provides novel nucleic acids for producing arginine. In some embodiments, the nucleic acid comprises gene sequence encoding one or more arginine production circuit(s). In some embodiments, the nucleic acid comprises gene sequence encoding argA. In some embodiments, the nucleic acid comprises gene sequence encoding argB. In some embodiments, the nucleic acid comprises gene sequence encoding argC. In some embodiments, the nucleic acid comprises gene sequence encoding argD. In some embodiments, the nucleic acid comprises gene sequence encoding argE. In some embodiments, the nucleic acid comprises gene sequence encoding argF. In some embodiments, the nucleic acid comprises gene sequence encoding argG. In some embodiments, the nucleic acid comprises gene sequence encoding argH. In some embodiments, the nucleic acid comprises gene sequence encoding argI. In some embodiments, the nucleic acid comprises gene sequence encoding argJ. In some embodiments, the nucleic acid comprises gene sequence encoding carA. In some embodiments, the nucleic acid comprises gene sequence encoding carB. In some embodiments, the nucleic acid comprises gene sequence encoding argA(fbr).

In some embodiments, the nucleic acid comprises gene sequence encoding arginine biosynthesis genes selected from argA, argB, argC, argD, argE, argF, argG, argH, argI, argJ, carA, and carB and feedback resistant argA and any combinations thereof. In some embodiments, the nucleic acid sequence comprising gene sequence encoding arginine biosynthesis genes selected from argA, argB, argC, argD, argE, argF, argG, argH, argI, argJ, carA, and carB and feedback resistant argA and any combinations thereof further comprises nucleic acid sequence encoding anti-CD47 antibody.

In some embodiments, the disclosure provides novel nucleic acids for producing arginine. In some embodiments, the nucleic acid comprises gene sequence encoding one or more arginine production polypeptides. In one of the nucleic acid embodiments described herein, the nucleic acid sequence encoding the arginine production enzyme comprises argA(fbr) (feedback resistant argA). Accordingly, in one embodiment, the nucleic acid sequence comprising the argA(fbr) gene has at least about 80% identity with SEQ ID NO: 102. In one embodiment, the nucleic acid sequence comprising the argA(fbr) gene has at least about 90% identity with SEQ ID NO: 102. In another embodiment, the nucleic acid sequence comprising the argA(fbr) gene has at least about 95% identity with SEQ ID NO: 102. Accordingly, in one embodiment, the nucleic acid sequence comprising the argA(fbr) gene has at least about 85%, 86%, 87%, 88%, 89%, 90%, 91%, 92%, 93%, 94%, 95%, 96%, 97%, 98%, or 99% identity with SEQ ID NO: 102. In another embodiment, the nucleic acid sequence comprising the argA(fbr) gene comprises SEQ ID NO: 102. In yet another embodiment, the nucleic acid sequence comprising the argA(fbr) gene consists of SEQ ID NO: 102.

In one of the nucleic acid embodiments described herein, the arginine production enzyme comprises argA(fbr). In one embodiment, the nucleic acid sequence encodes a polypeptide, which has at least about 80% identity with SEQ ID NO: 103. In one embodiment, the nucleic acid sequence encodes a polypeptide, which has at least about 90% identity with SEQ ID NO: 103. In another embodiment, the nucleic acid sequence encodes a polypeptide, which has at least about 95% identity with SEQ ID NO: 103. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 103. In another embodiment, the nucleic acid sequence encodes a polypeptide, which comprises a sequence which encodes SEQ ID NO: 103. In yet another embodiment, the nucleic acid sequence encodes a polypeptide, which consists of a sequence which encodes SEQ ID NO: 103.

In some embodiments, the disclosure provides novel nucleic acids producing tryptophan. In some embodiments, the nucleic acid comprises gene sequence encoding one or more tryptophan production enzyme(s). In some embodiments, the nucleic acid comprises gene sequence encoding TrpE. In some embodiments, the nucleic acid comprises gene sequence encoding TrpD. In some embodiments, the nucleic acid comprises gene sequence encoding TrpC. In some embodiments, the nucleic acid comprises gene sequence encoding TrpB. In some embodiments, the nucleic acid comprises gene sequence encoding TrpA. In some embodiments, the nucleic acid comprises gene sequence encoding AroG. In some embodiments, the nucleic acid comprises gene sequence encoding AroF. In some embodiments, the nucleic acid comprises gene sequence encoding AroH. In some embodiments, the nucleic acid comprises gene sequence encoding AroB. In some embodiments, the nucleic acid comprises gene sequence encoding AroD. In some embodiments, the nucleic acid comprises gene sequence encoding AroE. In some embodiments, the nucleic acid comprises gene sequence encoding AroK. In some embodiments, the nucleic acid comprises gene sequence encoding AroA. In some embodiments, the nucleic acid comprises gene sequence encoding aroG(fbr). In some embodiments, the nucleic acid comprises gene sequence encoding trpE(fbr). In some embodiments, the nucleic acid comprises gene sequence encoding serA(fbr). In some embodiments, the nucleic acid comprises gene sequence encoding YddG. In some embodiments, the nucleic acid comprises gene sequence encoding kynureninase. In some embodiments, the nucleic acid comprises gene sequence selected from TrpE, TrpD, TrpC, TrpB, and TrpA and any combinations thereof. In some embodiments, the nucleic acid comprises gene sequence selected from TrpE, TrpD, TrpC, TrpB, TrpA and kynureninase and any combinations thereof. In some embodiments, the nucleic acid comprises gene sequence selected from TrpE, TrpD, TrpC, TrpB, TrpA, AroG, AroF, AroH and any combinations thereof. In some embodiments, the nucleic acid comprises gene sequence selected from TrpE, TrpD, TrpC, TrpB, TrpA, AroG, AroF, AroH and kynureninase and any combinations thereof. In some embodiments, the nucleic acid comprises gene sequence selected from TrpE, TrpD, TrpC, TrpB, TrpA, AroG, AroF, AroH, AroB, AroD, AroE, AroK, and aroA and any combinations thereof. In some embodiments, the nucleic acid comprises gene sequence selected from TrpE, TrpD, TrpC, TrpB, TrpA, AroG, AroF, AroH, AroB, AroD, AroE, AroK, and aroA and kynureninase and any combinations thereof. In some embodiments, the nucleic acid comprises gene sequence selected from AroG(fbr), TrpE(fbr), TrpD, TrpC, TrpB, TrpA and any combinations thereof. In some embodiments, the nucleic acid comprises gene sequence selected from AroG(fbr), TrpE(fbr), TrpD, TrpC, TrpB, TrpA and kynureninase and any combinations thereof. In some embodiments, the nucleic acid comprises gene sequence selected from AroG(fbr), SerA(fbr), TrpE(fbr), TrpD, TrpC, TrpB, TrpA and any combinations thereof. In some embodiments, the nucleic acid comprises gene sequence selected from AroG(fbr), SerA(fbr), TrpE(fbr), TrpD, TrpC, TrpB, TrpA and kynureninase and any combinations thereof. In some embodiments, the nucleic acid comprises gene sequence selected from AroG(fbr), SerA(fbr), TrpE(fbr), TrpD, TrpC, TrpB, TrpA, YddG and any combinations thereof. In some embodiments, the nucleic acid comprises gene sequence selected from AroG(fbr), SerA(fbr), TrpE(fbr), TrpD, TrpC, TrpB, TrpA YddG and kynureninase and any combinations thereof.

In some embodiments, the nucleic acid comprising gene sequence encoding kynureninase further comprised nucleic acid sequence comprising gene sequence encoding IL-15.

In some embodiments, the disclosure provides novel nucleic acids for secreting IL-15. In some embodiments, the nucleic acid comprises gene sequence encoding IL-15 for secretion. In one of the nucleic acid embodiments described herein, the nucleic acid sequence encoding IL-15 for secretion comprises PhoA-Il-15. Accordingly, in one embodiment, the nucleic acid sequence comprising the Il-15 gene has at least about 80% identity with SEQ ID NO: 957. In one embodiment, the nucleic acid sequence comprising the Il-15 gene has at least about 90% identity with SEQ ID NO: 957. In another embodiment, the nucleic acid sequence comprising the Il-15 gene has at least about 95% identity with SEQ ID NO: 957. Accordingly, in one embodiment, the nucleic acid sequence comprising the Il-15 gene has at least about 85%, 86%, 87%, 88%, 89%, 90%, 91%, 92%, 93%, 94%, 95%, 96%, 97%, 98%, or 99% identity with SEQ ID NO: 957. In another embodiment, the nucleic acid sequence comprising the 11-15 gene comprises SEQ ID NO: 957. In yet another embodiment, the nucleic acid sequence comprising the Il-15 gene consists of SEQ ID NO: 957.

In one of the nucleic acid embodiments described herein, the nucleic acid encodes IL-15 (OmpF secretion tag). In one embodiment, the nucleic acid sequence encodes a polypeptide, which has at least about 80% identity with SEQ ID NO: 935. In one embodiment, the nucleic acid sequence encodes a polypeptide, which has at least about 90% identity with SEQ ID NO: 935. In another embodiment, the nucleic acid sequence encodes a polypeptide, which has at least about 95% identity with SEQ ID NO: 935. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 935. In another embodiment, the nucleic acid sequence encodes a polypeptide, which comprises a sequence which encodes SEQ ID NO: 935. In yet another embodiment, the nucleic acid sequence encodes a polypeptide, which consists of a sequence which encodes SEQ ID NO: 935.

In one of the nucleic acid embodiments described herein, the nucleic acid encodes IL-15 (PhoA secretion tag). In one embodiment, the nucleic acid sequence encodes a polypeptide, which has at least about 80% identity with SEQ ID NO: 936. In one embodiment, the nucleic acid sequence encodes a polypeptide, which has at least about 90% identity with SEQ ID NO: 936. In another embodiment, the nucleic acid sequence encodes a polypeptide, which has at least about 95% identity with SEQ ID NO: 936. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 936. In another embodiment, the nucleic acid sequence encodes a polypeptide, which comprises a sequence which encodes SEQ ID NO: 936. In yet another embodiment, the nucleic acid sequence encodes a polypeptide, which consists of a sequence which encodes SEQ ID NO: 936.

In one of the nucleic acid embodiments described herein the nucleic acid encodes IL-15 (TorA secretion tag). In one embodiment, the nucleic acid sequence encodes a polypeptide, which has at least about 80% identity with SEQ ID NO: 937. In one embodiment, the nucleic acid sequence encodes a polypeptide, which has at least about 90% identity with SEQ ID NO: 937. In another embodiment, the nucleic acid sequence encodes a polypeptide, which has at least about 95% identity with SEQ ID NO: 937. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 937. In another embodiment, the nucleic acid sequence encodes a polypeptide, which comprises a sequence which encodes SEQ ID NO: 937. In yet another embodiment, the nucleic acid sequence encodes a polypeptide, which consists of a sequence which encodes SEQ ID NO: 937.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (*Pseudomonas*). Accordingly, in one embodiment, the nucleic acid sequence comprising the kynU gene has at least about 80% identity with SEQ ID NO: 68. In one embodiment, the nucleic acid sequence comprising the kynU gene has at least about 90% identity with SEQ ID NO: 68. In another embodiment, the nucleic acid sequence comprising the kynU gene has at least about 95% identity with SEQ ID NO: 68. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 68. In another embodiment, the nucleic acid sequence comprising the kynU gene comprises SEQ ID NO: 68. In yet another embodiment, the nucleic acid sequence comprising the kynU gene consists of SEQ ID NO: 68.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (Human). Accordingly, in one embodiment, the nucleic acid sequence comprising the kynU gene has at least about 80% identity with SEQ ID NO: 69. In one embodiment, the nucleic acid sequence comprising the kynU gene has at least about 90% identity with SEQ ID NO: 69. In another embodiment, the nucleic acid sequence comprising the kynU gene has at least about 95% identity with SEQ ID NO: 69. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 69. In another embodiment, the nucleic acid sequence comprising the kynU gene comprises SEQ ID NO: 69. In yet another embodiment, the nucleic acid sequence comprising the kynU gene consists of SEQ ID NO: 69.

In some embodiments, the disclosure provides novel nucleic acids for depleting kynurenine. In some embodiments, the nucleic acid comprises gene sequence encoding one or more kynurenine depleting enzymes. In one of the nucleic acid embodiments described herein, the nucleic acid sequence encoding the kynurenine catabolism enzyme comprises kynU (*Shewanella*). Accordingly, in one embodiment, the nucleic acid sequence comprising the kynU gene has at least about 80% identity with SEQ ID NO: 70. In one embodiment, the nucleic acid sequence comprising the kynU gene has at least about 90% identity with SEQ ID NO: 70. In another embodiment, the nucleic acid sequence comprising the kynU gene has at least about 95% identity with SEQ ID NO: 70. Accordingly, in one embodiment, the nucleic acid sequence comprising the kynU gene has at least about 85%, 86%, 87%, 88%, 89%, 90%, 91%, 92%, 93%, 94%, 95%, 96%, 97%, 98%, or 99% identity with SEQ ID NO: 70. In another embodiment, the nucleic acid sequence comprising the kynU gene comprises SEQ ID NO: 70. In yet another embodiment, the nucleic acid sequence comprising the kynU gene consists of SEQ ID NO: 70.

In some embodiments, the disclosure provides novel nucleic acids for producing tryptophan. In some embodiments, the nucleic acid comprises gene sequence encoding one or more tryptophan production enzymes. In one of the nucleic acid embodiments described herein, the nucleic acid sequence encoding the kynurenine catabolism enzyme comprises trpE. Accordingly, in one embodiment, the nucleic acid sequence comprising the trpE gene has at least about 80% identity with SEQ ID NO: 50. In one embodiment, the nucleic acid sequence comprising the trpE gene has at least about 90% identity with SEQ ID NO: 50. In another embodiment, the nucleic acid sequence comprising the trpE gene has at least about 95% identity with SEQ ID NO: 50. Accordingly, in one embodiment, the nucleic acid sequence comprising the trpE gene has at least about 85%, 86%, 87%, 88%, 89%, 90%, 91%, 92%, 93%, 94%, 95%, 96%, 97%, 98%, or 99% identity with SEQ ID NO: 50. In another embodiment, the nucleic acid sequence comprising the trpE gene comprises SEQ ID NO: 50. In yet another embodiment, the nucleic acid sequence comprising the trpE gene consists of SEQ ID NO: 50.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpD. Accordingly, in one embodiment, the nucleic acid sequence comprising the trpD gene has at least about 80% identity with SEQ ID NO: 51. In one embodiment, the nucleic acid sequence comprising the trpD gene has at least about 90% identity with SEQ ID NO: 51. In another embodiment, the nucleic acid sequence comprising the trpD gene has at least about 95% identity with SEQ ID NO: 51. Accordingly, in one embodiment, the nucleic acid sequence comprising the trpD gene has at least about 85%, 86%, 87%, 88%, 89%, 90%, 91%, 92%, 93%, 94%, 95%, 96%, 97%, 98%, or 99% identity with SEQ ID NO: 51. In another embodiment, the nucleic acid sequence comprising the trpD gene comprises SEQ ID NO: 51. In yet another embodiment, the nucleic acid sequence comprising the trpD gene consists of SEQ ID NO: 51.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpC. Accordingly, in one embodiment, the nucleic acid sequence comprising the trpC gene has at least about 80% identity with SEQ ID NO: 52. In one embodiment, the nucleic acid sequence comprising the trpC gene has at least about 90% identity with SEQ ID NO: 52. In another embodiment, the nucleic acid sequence comprising the trpC gene has at least about 95% identity with SEQ ID NO: 52. Accordingly, in one embodiment, the nucleic acid sequence comprising the trpC gene has at least about 85%, 86%, 87%, 88%, 89%, 90%, 91%, 92%, 93%, 94%, 95%, 96%, 97%, 98%, or 99% identity with SEQ ID NO: 52. In another embodiment, the nucleic acid sequence comprising the trpC gene comprises SEQ ID NO: 52. In yet another embodiment, the nucleic acid sequence comprising the trpC gene consists of SEQ ID NO: 52.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpB. Accordingly, in one embodiment, the nucleic acid sequence comprising the trpB gene has at least about 80% identity with SEQ ID NO: 53. In one embodiment, the nucleic acid sequence comprising the trpB gene has at least about 90% identity with SEQ ID NO: 53. In another embodiment, the nucleic acid sequence comprising the trpB gene has at least about 95% identity with SEQ ID NO: 53. Accordingly, in one embodiment, the nucleic acid sequence comprising the trpB gene has at least about 85%, 86%, 87%, 88%, 89%, 90%, 91%, 92%, 93%, 94%, 95%, 96%, 97%, 98%, or 99% identity with SEQ ID NO: 53. In another embodiment, the nucleic acid sequence comprising the trpB gene comprises SEQ ID NO: 53. In yet another embodiment, the nucleic acid sequence comprising the trpB gene consists of SEQ ID NO: 53.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpA. Accordingly, in one embodiment, the nucleic acid sequence comprising the trpA gene has at least about 80% identity with SEQ ID NO: 54. In one embodiment, the nucleic acid sequence comprising the trpA gene has at least about 90% identity with SEQ ID NO: 54. In another embodiment, the nucleic acid sequence comprising the trpA gene has at least about 95% identity with SEQ ID NO: 54. Accordingly, in one embodiment, the nucleic acid sequence comprising the trpA gene has at least about 85%, 86%, 87%, 88%, 89%, 90%, 91%, 92%, 93%, 94%, 95%, 96%, 97%, 98%, or 99% identity with SEQ ID NO: 54. In another embodiment, the nucleic acid sequence comprising the trpA gene comprises SEQ ID NO: 54. In yet another embodiment, the nucleic acid sequence comprising the trpA gene consists of SEQ ID NO: 54.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises aroG(fbr). Accordingly, in one embodiment, the nucleic acid sequence comprising the aroG(fbr) gene has at least about 80% identity with SEQ ID NO: 862. In one embodiment, the nucleic acid sequence comprising the aroG(fbr) gene has at least about 90% identity with SEQ ID NO: 862. In another embodiment, the nucleic acid sequence comprising the aroG(fbr) gene has at least about 95% identity with SEQ ID NO: 862. Accordingly, in one embodiment, the nucleic acid sequence comprising the aroG(fbr) gene has at least about 85%, 86%, 87%, 88%, 89%, 90%, 91%, 92%, 93%, 94%, 95%, 96%, 97%, 98%, or 99% identity with SEQ ID NO: 862. In another embodiment, the nucleic acid sequence comprising the aroG(fbr) gene comprises SEQ ID NO: 862. In yet another embodiment, the nucleic acid sequence comprising the aroG(fbr) gene consists of SEQ ID NO: 862.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises serA. Accordingly, in one embodiment, the nucleic acid sequence comprising the serA gene has at least about 80% identity with SEQ ID NO: 864. In one embodiment, the nucleic acid sequence comprising the serA gene has at least about 90% identity with SEQ ID NO: 864. In another embodiment, the nucleic acid sequence comprising the serA gene has at least about 95% identity with SEQ ID NO: 864. Accordingly, in one embodiment, the nucleic acid sequence comprising the serA gene has at least about 85%, 86%, 87%, 88%, 89%, 90%, 91%, 92%, 93%, 94%, 95%, 96%, 97%, 98%, or 99% identity with SEQ ID NO: 864. In another embodiment, the nucleic acid sequence comprising the serA gene comprises SEQ ID NO: 864. In yet another embodiment, the nucleic acid sequence comprising the serA gene consists of SEQ ID NO: 864.

In some embodiments, the disclosure provides novel nucleic acids for producing tryptophan. In some embodiments, the nucleic acid comprises gene sequence encoding one or more tryptophan production enzyme(s). In one of the nucleic acid embodiments described herein, the nucleic acid sequence encoding the tryptophan producing enzyme comprises trpE(fbr). Accordingly, in one embodiment, the nucleic acid sequence comprising the trpE(fbr) gene has at least about 80% identity with SEQ ID NO: 879. In one embodiment, the nucleic acid sequence comprising the trpE(fbr) gene has at least about 90% identity with SEQ ID NO: 879. In another embodiment, the nucleic acid sequence comprising the trpE(fbr) gene has at least about 95% identity with SEQ ID NO: 879. Accordingly, in one embodiment, the nucleic acid sequence comprising the trpE(fbr) gene has at least about 85%, 86%, 87%, 88%, 89%, 90%, 91%, 92%, 93%, 94%, 95%, 96%, 97%, 98%, or 99% identity with SEQ ID NO: 879. In another embodiment, the nucleic acid sequence comprising the trpE(fbr) gene comprises SEQ ID NO: 879. In yet another embodiment, the nucleic acid sequence comprising the trpE(fbr) gene consists of SEQ ID NO: 879.

In one of the nucleic acid embodiments described herein, the kynurenine degradation enzyme comprises Kynureninase (*Pseudomonase fluorescens*). In one embodiment, the nucleic acid sequence encodes a polypeptide, which has at least about 80% identity with SEQ ID NO: 65. In one embodiment, the nucleic acid sequence encodes a polypeptide, which has at least about 90% identity with SEQ ID NO: 65. In another embodiment, the nucleic acid sequence encodes a polypeptide, which has at least about 95% identity with SEQ ID NO: 65. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 65. In another embodiment, the nucleic acid sequence encodes a polypeptide, which comprises a sequence which encodes SEQ ID NO: 65. In yet another embodiment, the nucleic acid sequence encodes a polypeptide, which consists of a sequence which encodes SEQ ID NO: 65.

In one of the nucleic acid embodiments described herein, the kynurenine degradation enzyme comprises Kynureninase (Human). In one embodiment, the nucleic acid sequence encodes a polypeptide, which has at least about 80% identity with SEQ ID NO: 66. In one embodiment, the nucleic acid sequence encodes a polypeptide, which has at least about 90% identity with SEQ ID NO: 66. In another embodiment, the nucleic acid sequence encodes a polypeptide, which has at least about 95% identity with SEQ ID NO: 66. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 66. In another embodiment, the nucleic acid sequence encodes a polypeptide, which comprises a sequence which encodes SEQ ID NO: 66. In yet another embodiment, the nucleic acid sequence encodes a polypeptide, which consists of a sequence which encodes SEQ ID NO: 66.

In one of the nucleic acid embodiments described herein, the kynurenine degradation enzyme comprises Kynureninase (*Shewanella*)

In one embodiment, the nucleic acid sequence encodes a polypeptide, which has at least about 80% identity with SEQ ID NO: 67. In one embodiment, the nucleic acid sequence encodes a polypeptide, which has at least about 90% identity with SEQ ID NO: 67. In another embodiment, the nucleic acid sequence encodes a polypeptide, which has at least about 95% identity with SEQ ID NO: 67. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 67. In another embodiment, the nucleic acid sequence encodes a polypeptide, which comprises a sequence which encodes SEQ ID NO: 67. In yet another embodiment, the nucleic acid sequence encodes a polypeptide, which consists of a sequence which encodes SEQ ID NO: 67.

In one of the nucleic acid embodiments described herein, the tryptophan production enzyme comprises TrpE. In one embodiment, the nucleic acid sequence encodes a polypeptide, which has at least about 80% identity with SEQ ID NO: 55. In one embodiment, the nucleic acid sequence encodes a polypeptide, which has at least about 90% identity with SEQ ID NO: 55. In another embodiment, the nucleic acid sequence encodes a polypeptide, which has at least about 95% identity with SEQ ID NO: 55. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 55. In another embodiment, the nucleic acid sequence encodes a polypeptide, which comprises a sequence which encodes SEQ ID NO: 55. In yet another embodiment, the nucleic acid sequence encodes a polypeptide, which consists of a sequence which encodes SEQ ID NO: 55.

In one of the nucleic acid embodiments described herein, the tryptophan production enzyme comprises trpD. In one embodiment, the nucleic acid sequence encodes a polypeptide, which has at least about 80% identity with SEQ ID NO: 56. In one embodiment, the nucleic acid sequence encodes a polypeptide, which has at least about 90% identity with SEQ ID NO: 56. In another embodiment, the nucleic acid sequence encodes a polypeptide, which has at least about 95% identity with SEQ ID NO: 56. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 56. In another embodiment, the nucleic acid sequence encodes a polypeptide, which comprises a sequence which encodes SEQ ID NO: 56. In yet another embodiment, the nucleic acid sequence encodes a polypeptide, which consists of a sequence which encodes SEQ ID NO: 56.

In one of the nucleic acid embodiments described herein, the tryptophan production enzyme comprises TrpC. In one embodiment, the nucleic acid sequence encodes a polypeptide, which has at least about 80% identity with SEQ ID NO: 57. In one embodiment, the nucleic acid sequence encodes a polypeptide, which has at least about 90% identity with SEQ ID NO: 57. In another embodiment, the nucleic acid sequence encodes a polypeptide, which has at least about 95% identity with SEQ ID NO: 57. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 57. In another embodiment, the nucleic acid sequence encodes a polypeptide, which comprises a sequence which encodes SEQ ID NO: 57. In yet another embodiment, the nucleic acid sequence encodes a polypeptide, which consists of a sequence which encodes SEQ ID NO: 57.

In one of the nucleic acid embodiments described herein, the tryptophan production enzyme comprises TrpB. In one embodiment, the nucleic acid sequence encodes a polypeptide, which has at least about 80% identity with SEQ ID NO: 58. In one embodiment, the nucleic acid sequence encodes a polypeptide, which has at least about 90% identity with SEQ ID NO: 58. In another embodiment, the nucleic acid sequence encodes a polypeptide, which has at least about 95% identity with SEQ ID NO: 58. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 58. In another embodiment, the nucleic acid sequence encodes a polypeptide, which comprises a sequence which encodes SEQ ID NO: 58. In yet another embodiment, the nucleic acid sequence encodes a polypeptide, which consists of a sequence which encodes SEQ ID NO: 58.

In one of the nucleic acid embodiments described herein, the tryptophan production enzyme comprises TrpA. In one embodiment, the nucleic acid sequence encodes a polypeptide, which has at least about 80% identity with SEQ ID NO: 59. In one embodiment, the nucleic acid sequence encodes a polypeptide, which has at least about 90% identity with SEQ ID NO: 59. In another embodiment, the nucleic acid sequence encodes a polypeptide, which has at least about 95% identity with SEQ ID NO: 59. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 59. In another embodiment, the nucleic acid sequence encodes a polypeptide, which comprises a sequence which encodes SEQ ID NO: 59. In yet another embodiment, the nucleic acid sequence encodes a polypeptide, which consists of a sequence which encodes SEQ ID NO: 59.

In one of the nucleic acid embodiments described herein, the tryptophan production enzyme comprises AroG(fbr). In one embodiment, the nucleic acid sequence encodes a polypeptide, which has at least about 80% identity with SEQ ID NO: 60. In one embodiment, the nucleic acid sequence encodes a polypeptide, which has at least about 90% identity with SEQ ID NO: 60. In another embodiment, the nucleic acid sequence encodes a polypeptide, which has at least about 95% identity with SEQ ID NO: 60. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 60. In another embodiment, the nucleic acid sequence encodes a polypeptide, which comprises a sequence which encodes SEQ ID NO: 60. In yet another embodiment, the nucleic acid sequence encodes a polypeptide, which consists of a sequence which encodes SEQ ID NO: 60.

In one of the nucleic acid embodiments described herein, the tryptophan production enzyme comprises TrpE(fbr). In one embodiment, the nucleic acid sequence encodes a polypeptide, which has at least about 80% identity with SEQ ID NO: 61. In one embodiment, the nucleic acid sequence encodes a polypeptide, which has at least about 90% identity with SEQ ID NO: 61. In another embodiment, the nucleic acid sequence encodes a polypeptide, which has at least about 95% identity with SEQ ID NO: 61. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 61. In another embodiment, the nucleic acid sequence encodes a polypeptide, which comprises a sequence which encodes SEQ ID NO: 61. In yet another embodiment, the nucleic acid sequence encodes a polypeptide, which consists of a sequence which encodes SEQ ID NO: 61.

In one of the nucleic acid embodiments described herein, the tryptophan production enzyme comprises SerA. In one embodiment, the nucleic acid sequence encodes a polypeptide, which has at least about 80% identity with SEQ ID NO: 62. In one embodiment, the nucleic acid sequence encodes a polypeptide, which has at least about 90% identity with SEQ ID NO: 62. In another embodiment, the nucleic acid sequence encodes a polypeptide, which has at least about 95% identity with SEQ ID NO: 62. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 62. In another embodiment, the nucleic acid sequence encodes a polypeptide, which comprises a sequence which encodes SEQ ID NO: 62. In yet another embodiment, the nucleic acid sequence encodes a polypeptide, which consists of a sequence which encodes SEQ ID NO: 62.

In one of the nucleic acid embodiments described herein, the tryptophan production enzyme comprises SerA(fbr). In one embodiment, the nucleic acid sequence encodes a polypeptide, which has at least about 80% identity with SEQ ID NO: 63. In one embodiment, the nucleic acid sequence encodes a polypeptide, which has at least about 90% identity with SEQ ID NO: 63. In another embodiment, the nucleic acid sequence encodes a polypeptide, which has at least about 95% identity with SEQ ID NO: 63. Accordingly, in one embodiment, the nucleic acid sequence encodes a polypeptide, which has at least about 85%, 86%, 87%, 88%, 89%, 90%, 91%, 92%, 93%, 94%, 95%, 96%, 97%, 98%, or 99% identity with SEQ ID NO: 63. In another embodiment, the nucleic acid sequence encodes a polypeptide, which comprises a sequence which encodes SEQ ID NO: 63. In yet another embodiment, the nucleic acid sequence encodes a polypeptide, which consists of a sequence which encodes SEQ ID NO: 63.

In some embodiments, the disclosure provides novel nucleic acids for tryptophan production. In some embodiments, the nucleic acid comprises gene sequence encoding one or more the tryptophan production enzyme cassette(s). In one of the nucleic acid embodiments described herein, the nucleic acid sequence encoding the tryptophan production enzyme cassette comprises a nucleic acid sequence comprising Fbr-aroG-serA. Accordingly, in one embodiment, nucleic acid sequence comprising the Fbr-aroG-serA has at least about 80% identity with SEQ ID NO: 863. In one embodiment, the nucleic acid sequence comprising Fbr-aroG-serA has at least about 90% identity with SEQ ID NO: 863. In one embodiment, the nucleic acid sequence comprising Fbr-aroG-serA has at least about 95% identity with SEQ ID NO: 863. In one embodiment, the nucleic acid sequence comprising Fbr-aroG-serA has at least about 85%, 86%, 87%, 88%, 89%, 90%, 91%, 92%, 93%, 94%, 95%, 96%, 97%, 98%, or 99% identity with SEQ ID NO: 863. In another embodiment, the nucleic acid sequence comprising Fbr-aroG-serA comprises the sequence of SEQ ID NO: 863. In another embodiment, the nucleic acid sequence comprising Fbr-aroG-serA consists of the sequence of SEQ ID NO: 863.

In some embodiments, the disclosure provides novel nucleic acids for tryptophan production. In some embodiments, the nucleic acid comprises gene sequence encoding the tryptophan production enzyme cassette(s). In one of the nucleic acid embodiments described herein, the nucleic acid sequence encoding the tryptophan production enzyme cassette comprises a nucleic acid sequence comprising TrpEDCBA. Accordingly, in one embodiment, nucleic acid sequence comprising the TrpEDCBA has at least about 80% identity with SEQ ID NO: 872. In one embodiment, the nucleic acid sequence comprising TrpEDCBA has at least about 90% identity with SEQ ID NO: 872. In one embodiment, the nucleic acid sequence comprising TrpEDCBA has at least about 95% identity with SEQ ID NO: 872. In one embodiment, the nucleic acid sequence comprising TrpEDCBA has at least about 85%, 86%, 87%, 88%, 89%, 90%, 91%, 92%, 93%, 94%, 95%, 96%, 97%, 98%, or 99% identity with SEQ ID NO: 872. In another embodiment, the nucleic acid sequence comprising TrpEDCBA comprises the sequence of SEQ ID NO: 872. In another embodiment, the nucleic acid sequence comprising TrpEDCBA consists of the sequence of SEQ ID NO: 872.

In some embodiments, the disclosure provides novel nucleic acids for tryptophan production. In some embodiments, the nucleic acid comprises gene sequence encoding the tryptophan production enzyme cassette(s). In one of the nucleic acid embodiments described herein, the nucleic acid sequence encoding the tryptophan production enzyme cassette comprises a nucleic acid sequence comprising fbrS40FTrpE-DCBA. Accordingly, in one embodiment, nucleic acid sequence comprising fbrS40FTrpE-DCBA has at least about 80% identity with SEQ ID NO: 878. In one embodiment, the nucleic acid sequence comprising fbrS40FTrpE-DCBA has at least about 90% identity with SEQ ID NO: 878. In one embodiment, the nucleic acid sequence comprising fbrS40FTrpE-DCBA has at least about 95% identity with SEQ ID NO: 878. In one embodiment, the nucleic acid sequence comprising fbrS40FTrpE-DCBA has at least about 85%, 86%, 87%, 88%, 89%, 90%, 91%, 92%, 93%, 94%, 95%, 96%, 97%, 98%, or 99% identity with SEQ ID NO: 878. In another embodiment, the nucleic acid sequence comprising fbrS40FTrpE-DCBA comprises the sequence of SEQ ID NO: 878. In another embodiment, the nucleic acid sequence comprising fbrS40FTrpE-DCBA consists of the sequence of SEQ ID NO: 878.

In any of the nucleic acid embodiments described above, the one or more nucleic acid sequence(s) for producing the anti-cancer molecule combinations are operably linked to one or more directly or indirectly inducible promoter(s). In some embodiments, the one or more nucleic acid sequence(s) are operably linked to a directly or indirectly inducible promoter that is induced under exogeneous environmental conditions, e.g., conditions found in the gut, the tumor microenvironment or other tissue specific conditions. In some embodiments, the one or more nucleic acid sequence(s) are operably linked to a directly or indirectly inducible promoter that is induced by metabolites found in the gut, the tumor microenvironment or other specific conditions. In some embodiments, the one or more nucleic acid sequence(s) are operably linked to a directly or indirectly inducible promoter that is induced under low-oxygen or anaerobic conditions. In some embodiments, the one or more nucleic acid sequence(s) are operably linked to a directly or indirectly inducible promoter that is induced under inflammatory conditions (e.g., RNS, ROS), as described herein. In some embodiments, the one or more nucleic acid sequence(s) are operably linked to a directly or indirectly inducible promoter that is induced under immunosuppressive conditions, e.g., as found in the tumor, as described herein. In some embodiments, the two or more gene sequence(s) are linked to a directly or indirectly inducible promoter that is induced by exposure a chemical or nutritional inducer, which may or may not be present under in vivo conditions and which may be present during in vitro conditions (such as strain culture, expansion, manufacture), such as tetracycline or arabinose, or others described herein. In some embodiments, the two or more payloads are all linked to a constitutive promoter. Such constitutive promoters are described in Table 48-Table 58 herein. In some embodiments, the two or more gene sequence are operably linked to the same promoter sequences. In some embodiments, the two or more gene sequence are operably linked to two or more different promoter sequences, which can either all be constitutive (same or different constitutive promoters), all inducible (by same or different inducers), or a mix of constitutive and inducible promoters.

In one embodiment, the one or more nucleic acid sequence(s) encoding one or more anti-cancer molecules is located on a plasmid in the bacterial cell. In another embodiment, the one or more nucleic acid sequence(s) encoding one or more anti-cancer molecules is located in the chromosome of the bacterial cell. In any of these nucleic acid embodiments, such the one or more nucleic acid sequence(s) encoding one or more anti-cancer molecules can be combined with any other nucleic acids encoding other anti-cancer molecules described herein.

Secretion

In any of the embodiments described herein, in which the genetically engineered microorganism produces a protein, polypeptide, peptide, or other anti-cancer, DNA, RNA, small molecule or other molecule intended to be secreted from the microorganism, the engineered microorganism may comprise a secretion mechanism and corresponding gene sequence(s) encoding the secretion system.

In some embodiments, the genetically engineered bacteria further comprise a native secretion mechanism or non-native secretion mechanism that is capable of secreting the anti-cancer molecule from the bacterial cytoplasm in the extracellular environment. Many bacteria have evolved sophisticated secretion systems to transport substrates across the bacterial cell envelope. Substrates, such as small molecules, proteins, and DNA, may be released into the extracellular space or periplasm (such as the gut lumen or other space), injected into a target cell, or associated with the bacterial membrane.

In Gram-negative bacteria, secretion machineries may span one or both of the inner and outer membranes. In some embodiments, the genetically engineered bacteria further comprise a non-native double membrane-spanning secretion system. Double membrane-spanning secretion systems include, but are not limited to, the type I secretion system (T1SS), the type II secretion system (T2SS), the type III secretion system (T3SS), the type IV secretion system (T4SS), the type VI secretion system (T6SS), and the resistance-nodulation-division (RND) family of multi-drug efflux pumps (Pugsley 1993; Gerlach et al., 2007; Collinson et al., 2015; Costa et al., 2015; Reeves et al., 2015; WO2014138324A1, incorporated herein by reference). Mycobacteria, which have a Gram-negative-like cell envelope, may also encode a type VII secretion system (T7SS) (Stanley et al., 2003). With the exception of the T2SS, double membrane-spanning secretions generally transport substrates from the bacterial cytoplasm directly into the extracellular space or into the target cell. In contrast, the T2SS and secretion systems that span only the outer membrane may use a two-step mechanism, wherein substrates are first translocated to the periplasm by inner membrane-spanning transporters, and then transferred to the outer membrane or secreted into the extracellular space. Outer membrane-spanning secretion systems include, but are not limited to, the type V secretion or autotransporter system or autosecreter system (T5SS), the curli secretion system, and the chaperone-usher pathway for pili assembly (Saier, 2006; Costa et al., 2015).

In some embodiments in which the one or more proteins of interest or therapeutic proteins are secreted or exported from the microorganism, the engineered microorganism comprises gene sequence(s) that includes a secretion tag. In some embodiments, the one or more proteins of interest or therapeutic proteins include a "secretion tag" of either RNA or peptide origin to direct the one or more proteins of interest or therapeutic proteins to specific secretion systems. For example, a secretion tag for the Type I Hemolysin secretion system is encoded in the C-terminal 53 amino acids of the alpha hemolysin protein (HlyA).

In some embodiments, a Hemolysin-based Secretion System is used to secrete the molecule of interest, e.g., therapeutic peptide. Type I Secretion systems offer the advantage of translocating their passenger peptide directly from the cytoplasm to the extracellular space, obviating the two-step process of other secretion types. This pathway uses HlyB, an ATP-binding cassette transporter; HlyD, a membrane fusion protein; and TolC, an outer membrane protein. The assembly of these three proteins forms a channel through both the inner and outer membranes. HlyB inserts into inner membrane to form a pore, HlyD aligns HlyB with TolC (outer membrane pore) thereby forming a channel through inner and outer membrane. Natively, this channel is used to secrete HlyA, however, to secrete the therapeutic peptide of the present disclosure, the secretion signal-containing C-terminal portion of HlyA is fused to the C-terminal portion of a therapeutic peptide (star) to mediate secretion of this peptide. The C-terminal secretion tag can be removed by either an autocatalytic or protease-catalyzed e.g., OmpT cleavage thereby releasing the one or more proteins of interest or therapeutic proteins into the extracellular milieu. In some embodiments, the one or more proteins of interest or therapeutic proteins contain expressed as fusion protein with the 53 amino acids of the C termini of alpha-hemolysin (hlyA) of *E. coli* CFT073 (C terminal secretion tag).

In some embodiments, a Type V Autotransporter Secretion System is used to secrete the molecule of interest, e.g., therapeutic peptide. The Type V Auto-secretion System utilizes an N-terminal Sec-dependent peptide tag (inner membrane) and C-terminal tag (outer-membrane). This system uses the Sec-system to get from the cytoplasm to the periplasm. The C-terminal tag then inserts into the outer membrane forming a pore through which the "passenger protein" threads through. Due to the simplicity of the machinery and capacity to handle relatively large protein fluxes, the Type V secretion system is attractive for the extracellular production of recombinant proteins. For example, a therapeutic peptide (star) can be fused to an N-terminal secretion signal, a linker, and the beta-domain of an autotransporter. The N-terminal, Sec-dependent signal sequence directs the protein to the SecA-YEG machinery which moves the protein across the inner membrane into the periplasm, followed by subsequent cleavage of the signal sequence. The Beta-domain is recruited to the Bam complex ('Teta-barrel assembly machinery') where the beta-domain is folded and inserted into the outer membrane as a beta-barrel structure. The therapeutic peptide is threaded through the hollow pore of the beta-barrel structure ahead of the linker sequence. Once across the outer membrane, the passenger is released from the membrane-embedded C-terminal tag by either an autocatalytic, intein-like mechanism (left side of Bam complex) or via a membrane-bound protease (black scissors; right side of Bam complex) (i.e., OmpT). For example, a membrane-associated peptidase to a complimentary protease cut site in the linker. Thus, in some embodiments, the secreted molecule, such as a heterologous protein or peptide comprises an N-terminal secretion signal, a linker, and beta-domain of an autotransporter so as to allow the molecule to be secreted from the bacteria.

The N-terminal tag is removed by the Sec system. Thus, in some embodiments, the secretion system is able to remove this tag before secreting the one or more proteins of interest or therapeutic proteins, from the engineered bacteria. In the Type V auto-secretion-mediated secretion the N-terminal peptide secretion tag is removed upon translocation of the "passenger" peptide from the cytoplasm into the periplasmic compartment by the native Sec system. Further, once the auto-secretor is translocated across the outer membrane the C-terminal secretion tag can be removed by either an autocatalytic or protease-catalyzed e.g., OmpT cleavage thereby releasing the anti-cancer molecule(s) into the extracellular milieu.

In some embodiments, the genetically engineered bacteria of the invention comprise a type III or a type III-like secretion system (T3SS) from *Shigella, Salmonella, E. coli, Bivrio, Burkholderia, Yersinia, Chlamydia,* or *Pseudomonas*. The traditional T3SS is capable of transporting a protein from the bacterial cytoplasm to the host cytoplasm through a needle complex. In the Type III traditional secretion system, the basal body closely resembles the flagella, however, instead of a "tail"/whip, the traditional T3SS has a syringe to inject the passenger proteins into host cells. The secretion tag is encoded by an N-terminal peptide (lengths vary and there are several different tags, see PCT/US14/020972). The N-terminal tag is not removed from the polypeptides in this secretion system.

The T3SS may be modified to secrete the molecule from the bacterial cytoplasm, but not inject the molecule into the host cytoplasm. Thus, the molecule is secreted into the gut lumen, tumor microenvironment, or other extracellular space. In some embodiments, the genetically engineered bacteria comprise said modified T3SS and are capable of secreting the molecule of interest from the bacterial cytoplasm. In some embodiments, the secreted molecule, such as a heterologous protein or peptide comprises a type III secretion sequence that allows the molecule of interest to be secreted from the bacteria.

In some embodiments, the genetically engineered microorganisms comprise a modified Type III Secretion system. In the Flagellar modified Type III Secretion, the tag is encoded in 5'untranslated region of the mRNA and thus there is no peptide tag to cleave/remove. This modified system does not contain the "syringe" portion and instead uses the basal body of the flagella structure as the pore to translocate across both membranes and out through the forming flagella. If the fliC/fliD genes (encoding the flagella "tail"/whip) are disrupted the flagella cannot fully form and this promotes overall secretion. In some embodiments, the tail portion can be removed entirely.

In some embodiments, a flagellar type III secretion pathway is used to secrete the molecule of interest. In some embodiments, an incomplete flagellum is used to secrete a therapeutic peptide of interest by recombinantly fusing the peptide to an N-terminal flagellar secretion signal of a native flagellar component. In this manner, the intracellularly expressed chimeric peptide can be mobilized across the inner and outer membranes into the surrounding host environment.

For example, a modified flagellar type III secretion apparatus in which untranslated DNA fragment upstream of the gene fliC (encoding flagellin), e.g., a 173-bp region, is fused to the gene encoding the heterologous protein or peptide can be used to secrete polypeptides of interest (See, e.g., Majander et al., Extracellular secretion of polypeptides using a modified *Escherichia coli* flagellar secretion apparatus. Nat Biotechnol. 2005 April; 23(4):475-81). In some cases, the untranslated region from the fliC loci may not be sufficient to mediate translocation of the passenger peptide through the flagella. Here it may be necessary to extend the N-terminal signal into the amino acid coding sequence of FliC, for example, by using the 173 bp of untranslated region along with the first 20 amino acids of FliC (see, e.g., Duan et al., Secretion of Insulinotropic Proteins by Commensal Bacteria: Rewiring the Gut To Treat Diabetes, Appl. Environ. Microbiol. December 2008 vol. 74 no. 23 7437-7438).

In alternate embodiments, the genetically engineered bacteria further comprise a non-native single membrane-spanning secretion system. Single membrane-spanning transporters may act as a component of a secretion system, or may export substrates independently. Such transporters include, but are not limited to, ATP-binding cassette translocases, flagellum/virulence-related translocases, conjugation-related translocases, the general secretory system (e.g., the SecYEG complex in *E. coli*), the accessory secretory system in mycobacteria and several types of Gram-positive bacteria (e.g., *Bacillus anthracis, Lactobacillus johnsonii, Corynebacterium glutamicum, Streptococcus gordonii, Staphylococcus aureus*), and the twin-arginine translocation (TAT) system (Saier, 2006; Rigel and Braunstein, 2008; Albiniak et al., 2013). It is known that the general secretory and TAT systems can both export substrates with cleavable N-terminal signal peptides into the periplasm, and have been explored in the context of biopharmaceutical production. The TAT system may offer particular advantages, however, in that it is able to transport folded substrates, thus eliminating the potential for premature or incorrect folding. In certain embodiments, the genetically engineered bacteria comprise a TAT or a TAT-like system and are capable of secreting the anti-cancer molecule of interest from the bacterial cytoplasm. One of ordinary skill in the art would appreciate that the secretion systems disclosed herein may be modified to act in different species, strains, and subtypes of bacteria, and/or adapted to deliver different payloads.

In order to translocate a protein, e.g., therapeutic polypeptide, to the extracellular space, the polypeptide must first be translated intracellularly, mobilized across the inner membrane and finally mobilized across the outer membrane. Many effector proteins (e.g., therapeutic polypeptides)—particularly those of eukaryotic origin—contain disulphide bonds to stabilize the tertiary and quaternary structures. While these bonds are capable of correctly forming in the oxidizing periplasmic compartment with the help of periplasmic chaperones, in order to translocate the polypeptide across the outer membrane the disulphide bonds must be reduced and the protein unfolded again.

One way to secrete properly folded proteins in gram-negative bacteria-particularly those requiring disulphide bonds—is to target the reducing-environment periplasm in conjunction with a destabilizing outer membrane. In this manner the protein is mobilized into the oxidizing environment and allowed to fold properly. In contrast to orchestrated extracellular secretion systems, the protein is then able to escape the periplasmic space in a correctly folded form by membrane leakage. These "leaky" gram-negative mutants are therefore capable of secreting bioactive, properly disulphide-bonded polypeptides. In some embodiments, the genetically engineered bacteria have a "leaky" or de-stabilized outer membrane. Destabilizing the bacterial outer membrane to induce leakiness can be accomplished by deleting or mutagenizing genes responsible for tethering the outer membrane to the rigid peptidoglycan skeleton, including for example, lpp, ompC, ompA, ompF, tolA, tolB, and pal. Lpp is the most abundant polypeptide in the bacterial cell existing at ~500,000 copies per cell and functions as the primary 'staple' of the bacterial cell wall to the peptidoglycan. 1. Silhavy, T. J., Kahne, D. & Walker, S. The bacterial cell envelope. Cold Spring Harb Perspect Biol 2, a000414 (2010). TolA-PAL and OmpA complexes function similarly to Lpp and are other deletion targets to generate a leaky phenotype. Additionally, leaky phenotypes have been observed when periplasmic proteases are inactivated. The periplasm is very densely packed with protein and therefore encode several periplasmic proteins to facilitate protein turnover. Removal of periplasmic proteases such as degS, degP or nlpI can induce leaky phenotypes by promoting an excessive build-up of periplasmic protein. Mutation of the proteases can also preserve the effector polypeptide by preventing targeted degradation by these proteases.

Moreover, a combination of these mutations may synergistically enhance the leaky phenotype of the cell without major sacrifices in cell viability. Thus, in some embodiments, the engineered bacteria have one or more deleted or mutated membrane genes. In some embodiments, the engineered bacteria have a deleted or mutated lpp gene. In some embodiments, the engineered bacteria have one or more deleted or mutated gene(s), selected from ompA, ompA, and ompF genes. In some embodiments, the engineered bacteria have one or more deleted or mutated gene(s), selected from tolA, tolB, and pal genes. in some embodiments, the engineered bacteria have one or more deleted or mutated periplasmic protease genes. In some embodiments, the engineered bacteria have one or more deleted or mutated periplasmic protease genes selected from degS, degP, and nlpI. In some embodiments, the engineered bacteria have one or more deleted or mutated gene(s), selected from lpp, ompA, ompF, tolA, tolB, pal, degS, degP, and nlpI genes.

To minimize disturbances to cell viability, the leaky phenotype can be made inducible by placing one or more membrane or periplasmic protease genes, e.g., selected from lpp, ompA, ompF, tolA, tolB, pal, degS, degP, and nlpI, under the control of an inducible promoter. For example, expression of lpp or other cell wall stability protein or periplasmic protease can be repressed in conditions where the therapeutic polypeptide needs to be delivered (secreted). For instance, under inducing conditions a transcriptional repressor protein or a designed antisense RNA can be expressed which reduces transcription or translation of a target membrane or periplasmic protease gene. Conversely, overexpression of certain peptides can result in a destabilized phenotype, e.g., overexpression of colicins or the third topological domain of TolA, wherein peptide overexpression can be induced in conditions in which the therapeutic polypeptide needs to be delivered (secreted). These sorts of strategies would decouple the fragile, leaky phenotypes from biomass production. Thus, in some embodiments, the engineered bacteria have one or more membrane and/or periplasmic protease genes under the control of an inducible promoter.

Table 12 and Table 13 below lists secretion systems for Gram positive bacteria and Gram negative bacteria.

TABLE 12

Secretion systems for Gram positive bacteria

| Bacterial Strain | Relevant Secretion System |
| --- | --- |
| *C. novyi*-NT (Gram+) | Sec pathway |
|  | Twin-arginine (TAT) pathway |
| *C. butryicum* (Gram+) | Sec pathway |
|  | Twin-arginine (TAT) pathway |
| *Listeria monocytogenes* (Gram +) | Sec pathway |
|  | Twin-arginine (TAT) pathway |

TABLE 13

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
|---|---|---|---|---|---|---|---|
| IMPS - Gram-negative bacterial inner membrane channel-forming translocases | | | | | | | |
| ABC (SIP) | ATP binding cassette translocase | 3.A.1 | + | + | + | 3-4 | ATP |
| SEC (IISP) | General secretory translocase | 3.A.5 | + | + | + | ~12 | GTP OR ATP + PMF |
| Fla/Path (IIISP) | Flagellum/virulence-related translocase | 3.A.6 | + | − | − | >10 | ATP |
| Conj (IVSP) | Conjugation-related translocase | 3.A.7 | + | − | − | >10 | ATP |
| Tat (IISP) | Twin-arginine targeting translocase | 2.A.64 | + | + | + (chloroplasts) | 2-4 | PMF |
| Oxa1 (YidC) | Cytochrome oxidase biogenesis family | 2.A.9 | + | + | + (mitochondria chloroplasts) | 1 | None or PMF |
| MscL | Large conductance mechano-sensitive channel family | 1.A.22 | + | + | + | 1 | None |
| Holins | Holin functional superfamily | 1.E.1•21 | + | − | − | 1 | None |
| Eukaryotic Organelles | | | | | | | |
| MPT | Mitochondrial protein translocase | 3.A.B | − | − | + (mitochondrial) | >20 | ATP |
| CEPT | Chloroplast envelope protein translocase | 3.A.9 | (+) | − | + (chloroplasts) | >3 | GTP |
| Bcl-2 | Eukaryotic Bcl-2 family (programmed cell death) | 1.A.21 | − | − | + | 1? | None |
| Gram-negative bacterial outer membrane channel-forming translocases | | | | | | | |
| MTB (IISP) | Main terminal branch of the general secretory translocase | 3.A.15 | +[b] | − | − | ~14 | ATP; PMF |
| FUP | Fimbrial usher protein | 1.B.11 | +[b] | − | − | 1 | None |
| AT-1 | Auto-transporter-1 | 1.B.12 | +[b] | − | − | 1 | None |
| AT-2 | Auto-transporter-2 | 1.B.40 | +[b] | − | − | 1 | None |
| OMF (ISP) | | 1.B.17 | +[b] | − | +(?) | 1 | None |
| TPS | | 1.B.20 | + | − | + | 1 | None |
| Secretin (IISP and IISP) | | 1.B.22 | +[b] | − | − | 1 | None |
| OmpIP | Outer membrane insertion porin | 1.B.33 | + | − | + (mitochondria; chloroplasts) | ≥4 | None ? |

The above tables for gram positive and gram negative bacteria list secretion systems that can be used to secrete polypeptides and other molecules from the engineered bacteria, which are reviewed in Milton H. Saier, Jr. Microbe/ Volume 1, Number 9, 2006 "Protein Secretion Systems in Gram-Negative Bacteria Gram-negative bacteria possess many protein secretion-membrane insertion systems that apparently evolved independently", the contents of which is herein incorporated by reference in its entirety.

In some embodiments, the genetically engineered bacterial comprise a native or non-native secretion system described herein for the secretion of an anti-cancer molecule, e.g., a cytokine, antibody (e.g., scFv), metabolic enzyme, e.g., kynureninase, an others described herein.

In some embodiments, the secretion tag is selected from PhoA, OmpF, cvaC, TorA, fdnG, dmsA, PelB, HlyA secretion signal, and HlyA secretion signal. In some embodiments, the secretion tag is the PhoA secretion signal. In some embodiments, the secretion tag comprises a sequence selected from SEQ ID NO: 745 or SEQ ID NO: 746. In some embodiments, the secretion tag is the OmpF secretion signal. In some embodiments, the secretion tag is the OmpF secretion signal. In some embodiments, the secretion tag comprises SEQ ID NO: 747. In some embodiments, the secretion tag is the cvaC secretion signal. In some embodiments, the secretion tag comprises SEQ ID NO: 748. In some embodiments, the secretion tag is the torA secretion signal. In some embodiments, the secretion tag comprises SEQ ID NO: 749. In some embodiments, the secretion tag is the fdnG secretion signal. In some embodiments, the secretion tag comprises SEQ ID NO: 750. In some embodiments, the secretion tag is the dmsA secretion signal. In some embodiments, the secretion tag comprises SEQ ID NO: 751. In some embodiments, the secretion tag is the PelB secretion signal. In some embodiments, the secretion tag comprises SEQ ID NO: 752. In some embodiments, the secretion tag is the HlyA secretion signal. In some embodiments, the secretion tag comprises a sequence selected from SEQ ID NO: 753 and SEQ ID NO: 754.

In some embodiments, genetically engineered bacteria comprise a nucleic acid sequence encodes a secretion tag. In one embodiment, the nucleic acid sequence encoding the secretion tag is at least about 80%, at least about 85%, at least about 90%, at least about 95%, or at least about 99% homologous to a sequence selected from of SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, and/or SEQ ID NO: 754. In one embodiment, the nucleic acid sequence encoding the secretion tag comprises a sequence selected from SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, and/or SEQ ID NO: 754. In one embodiment, the nucleic acid sequence encoding the secretion tag consists of a sequence selected from SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, and/or SEQ ID NO: 754.

In some embodiments, the genetically engineered bacteria encode a polypeptide comprising a secretion tag selected from Adhesin (ECOLIN_19880), DsbA (ECOLIN_21525), GltI (ECOLIN_03430), GspD (ECOLIN_16495), HdeB (ECOLIN_19410), MalE (ECOLIN_22540), OppA (ECOLIN_07295), PelB, PhoA (ECOLIN_02255), PpiA (ECOLIN_18620), TolB, tort, OmpA, PelB, DsbA mglB, and lamB secretion tags.

, In some embodiments, genetically engineered bacteria comprise a nucleic acid sequence encodes a secretion tag. In one embodiment, the nucleic acid sequence encoding the secretion tag is at least about 80%, at least about 85%, at least about 90%, at least about 95%, or at least about 99% homologous to a sequence selected from of SEQ ID NO: 1222, SEQ ID NO: 1223, SEQ ID NO: 1224, SEQ ID NO: 1225, SEQ ID NO: 1226, SEQ ID NO: 1227, SEQ ID NO: 1228, SEQ ID NO: 1229, SEQ ID NO: 1230, SEQ ID NO: 1141, SEQ ID NO: 1142, SEQ ID NO: 1143, SEQ ID NO: 1144, SEQ ID NO: 1145, SEQ ID NO: 1253, SEQ ID NO: 1157, SEQ ID NO: 1158, SEQ ID NO: 1159, SEQ ID NO: 1160, SEQ ID NO: 1161, SEQ ID NO: 1162, SEQ ID NO: 1163, SEQ ID NO: 1164, SEQ ID NO: 1165, SEQ ID NO: 1166, and SEQ ID NO: 1167. In one embodiment, the nucleic acid sequence encoding the secretion tag comprises a sequence selected from SEQ ID NO: 1222, SEQ ID NO: 1223, SEQ ID NO: 1224, SEQ ID NO: 1225, SEQ ID NO: 1226, SEQ ID NO: 1227, SEQ ID NO: 1228, SEQ ID NO: 1229, SEQ ID NO: 1230, SEQ ID NO: 1141, SEQ ID NO: 1142, SEQ ID NO: 1143, SEQ ID NO: 1144, SEQ ID NO: 1145, SEQ ID NO: 1253, SEQ ID NO: 1157, SEQ ID NO: 1158, SEQ ID NO: 1159, SEQ ID NO: 1160, SEQ ID NO: 1161, SEQ ID NO: 1162, SEQ ID NO: 1163, SEQ ID NO: 1164, SEQ ID NO: 1165, SEQ ID NO: 1166, and SEQ ID NO: 1167. In one embodiment, the nucleic acid sequence encoding the secretion tag consists of a sequence selected from SEQ ID NO: 1222, SEQ ID NO: 1223, SEQ ID NO: 1224, SEQ ID NO: 1225, SEQ ID NO: 1226, SEQ ID NO: 1227, SEQ ID NO: 1228, SEQ ID NO: 1229, SEQ ID NO: 1230, SEQ ID NO: 1141, SEQ ID NO: 1142, SEQ ID NO: 1143, SEQ ID NO: 1144, SEQ ID NO: 1145, SEQ ID NO: 1253, SEQ ID NO: 1157, SEQ ID NO: 1158, SEQ ID NO: 1159, SEQ ID NO: 1160, SEQ ID NO: 1161, SEQ ID NO: 1162, SEQ ID NO: 1163, SEQ ID NO: 1164, SEQ ID NO: 1165, SEQ ID NO: 1166, and SEQ ID NO: 1167.

In some embodiments, the genetically engineered bacteria encode a polypeptide comprising a secretion tag, which has at least about 80%, 81%, 82%, 83%, 84%, 85%, 86%, 87%, 88%, 89%, 90%, 91%, 92%, 93%, 94%, 95%, 96%, 97%, 98%, or 99% identity a secretion tag polypeptide sequence selected from SEQ ID NO: 1218, SEQ ID NO: 1219, SEQ ID NO: 1181, SEQ ID NO: 1220, SEQ ID NO: 1221, SEQ ID NO: 1180, SEQ ID NO: 1184, SEQ ID NO: 1186, SEQ ID NO: 1190, SEQ ID NO: 1182, SEQ ID NO: 1135, SEQ ID NO: 1183, SEQ ID NO: 1188, SEQ ID NO: 1187, SEQ ID NO: 747, SEQ ID NO: 1185, and SEQ ID NO: 1189. In another embodiment, the secretion tag comprises a sequence selected from SEQ ID NO: 1218, SEQ ID NO: 1219, SEQ ID NO: 1181, SEQ ID NO: 1220, SEQ ID NO: 1221, SEQ ID NO: 1180, SEQ ID NO: 1184, SEQ ID NO: 1186, SEQ ID NO: 1190, SEQ ID NO: 1182, SEQ ID NO: 1135, SEQ ID NO: 1183, SEQ ID NO: 1188, SEQ ID NO: 1187, SEQ ID NO: 747, SEQ ID NO: 1185, and SEQ ID NO: 1189. In yet another embodiment, the secretion tag consists of a sequence selected from SEQ ID NO: 1218, SEQ ID NO: 1219, SEQ ID NO: 1181, SEQ ID NO: 1220, SEQ ID NO: 1221, SEQ ID NO: 1180, SEQ ID NO: 1184, SEQ ID NO: 1186, SEQ ID NO: 1190, SEQ ID NO: 1182, SEQ ID NO: 1135, SEQ ID NO: 1183, SEQ ID NO: 1188, SEQ ID NO: 1187, SEQ ID NO: 747, SEQ ID NO: 1185, and SEQ ID NO: 1189.

Any secretion tag or secretion system can be combined with any cytokine described herein, and can be used to generate a construct (plasmid based or integrated) which is driven by a directly or indirectly inducible or constitutive promoter described herein. In some embodiments, the secretion system is used in combination with one or more genomic mutations, which leads to the leaky or diffusible outer membrane phenotype (DOM), including but not limited to, lpp, n1P, tolA, PAL.

In some embodiments, the secretion system is selected from the type III flagellar, modified type III flagellar, type I (e.g., hemolysin system), type II, type IV, type V, type VI, and type VII secretion systems, resistance-nodulation-division (RND) multi-drug efflux pumps, a single membrane secretion system, Sec and, TAT secretion systems.

Any of the secretion systems described herein may according to the disclosure be employed to secrete the polypeptides of interest. In some embodiments, the therapeutic proteins secreted by the genetically engineered bacteria are modified to increase resistance to proteases, e.g. intestinal proteases.

In some embodiments, the genetically engineered microorganisms are capable of expressing any one or more of the described circuits in low-oxygen conditions, and/or in the presence of cancer and/or the tumor microenvironment, or tissue specific molecules or metabolites, and/or in the presence of molecules or metabolites associated with inflammation or immune suppression, and/or in the presence of metabolites that may be present in the gut, and/or in the presence of metabolites that may or may not be present in vivo, and may be present in vitro during strain culture, expansion, production and/or manufacture, such as arabinose and others described herein. In some embodiments, the gene sequences(s) are controlled by a promoter inducible by such conditions and/or inducers. In some embodiments, the gene sequences(s) are controlled by a constitutive promoter, as described herein. In some embodiments, the gene sequences(s) are controlled by a constitutive promoter, and are expressed in in vivo conditions and/or in vitro conditions, e.g., during expansion, production and/or manufacture, as described herein.

In some embodiments, any one or more of the described circuits are present on one or more plasmids (e.g., high copy or low copy) or are integrated into one or more sites in the microorganismal chromosome. Also, in some embodiments, the genetically engineered microorganisms are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, (6) one or more surface display circuits, such as any of the surface display circuits described herein and otherwise known in the art and (7) one or more circuits for the production or degradation of one or more metabolites (e.g., kynurenine, tryptophan, adenosine, arginine) described herein (8) combinations of one or more of such additional circuits. In any of these embodiments, the genetically engineered bacteria may be administered alone or in combination with one or more immune checkpoint inhibitors described herein, including but not limited anti-CTLA4, anti-PD1, or anti-PD-L1 antibodies.

Non-limiting examples of proteins of interest include cytokines, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, SIRPalpha and variants, hyaluronidase, antibodies, e.g., scFvs, including but not limited to checkpoint inhibitors (e.g., PD1, PDL1, CTLA4, and others described herein) and anti-CD47, anti-CD40, and metabolite producing or consuming enzymes, e.g., kynureninase, tryptophan and/or arginine synthesis enzymes, and adenosine degradation enzymes. These polypeptides may be mutated to increase stability, resistance to protease digestion, and/or activity.

TABLE 14

Comparison of Secretion systems for secretion of polypeptide from engineered bacteria

| Secretion System | Tag | Cleavage | Advantages | Other features |
|---|---|---|---|---|
| Modified Type III (flagellar) | mRNA (or N-terminal) | No cleavage necessary | No peptide tag Endogenous | May not be as suited for larger proteins Deletion of flagellar genes |
| Type V autotransporter | N- and C-terminal | Yes | Large proteins Endogenous Cleavable | 2-step secretion |
| Type I | C-terminal | No | | Tag; Exogenous Machinery |
| Diffusible Outer Membrane (DOM) | N-terminal | Yes | Disulfide bond formation | May affect cell fragility/ survivability/ growth/yield |

In some embodiments, the therapeutic polypeptides of interest are secreted using components of the flagellar type III secretion system. In a non-limiting example, such a therapeutic polypeptide of interest, such as, IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, hyaluronidase, tryptophan and/or arginine synthesis enzymes, antibodies, e.g., scFvs, including but not limited to checkpoint inhibitors (e.g., PD1, PDL1, CTLA4, and others described herein, kynureninase, adenosine degradation enzymes, is assembled behind a fliC-5'UTR (e.g., 173-bp untranslated region from the fliC loci), and is driven by the native promoter. In other embodiments, the expression of the therapeutic peptide of interested secreted using components of the flagellar type III secretion system is driven by a tet-inducible promoter. In alternate embodiments, an inducible promoter such as oxygen level-dependent promoters (e.g., FNR-inducible promoter), promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose is used. In some embodiments, the therapeutic polypeptide of interest is expressed from a plasmid (e.g., a medium copy plasmid). In some embodiments, the therapeutic polypeptide of interest is expressed from a construct which is integrated into fliC locus (thereby deleting fliC), where it is driven by the native FliC promoter. In some embodiments, an N terminal part of FliC (e.g., the first 20 amino acids of FliC) is included in the construct, to further increase secretion efficiency.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, hyaluronidase, tryptophan and/or arginine synthesis enzymes, antibodies, e.g., scFvs, including but not limited to checkpoint inhibitors (e.g., PD1, PDL1, CTLA4, and others described herein, kynureninase, adenosine degradation enzymes, are secreted using via a diffusible outer membrane (DOM) system. In some embodiments, the therapeutic polypeptide of interest is fused to a N-terminal Sec-dependent secretion signal. Non-limiting examples of such N-terminal Sec-dependent secretion signals include PhoA, OmpF, OmpA, and cvaC. In alternate embodiments, the therapeutic polypeptide of interest is fused to a Tat-dependent secretion signal. Exemplary Tat-dependent tags include TorA, FdnG, and DmsA.

In certain embodiments, the genetically engineered bacteria comprise deletions or mutations in one or more of the outer membrane and/or periplasmic proteins. Non-limiting examples of such proteins, one or more of which may be deleted or mutated, include lpp, pal, tolA, and/or nlpI. In some embodiments, lpp is deleted or mutated. In some embodiments, pal is deleted or mutated. In some embodiments, tolA is deleted or mutated. In other embodiments, nlpI is deleted or mutated. In yet other embodiments, certain periplasmic proteases are deleted or mutated, e.g., to increase stability of the polypeptide in the periplasm. Non-limiting examples of such proteases include degP and ompT. In some embodiments, degP is deleted or mutated. In some embodiments, ompT is deleted or mutated. In some embodiments, degP and ompT are deleted or mutated.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, hyaluronidase, tryptophan and/or arginine synthesis enzymes, antibodies, e.g., scFvs, including but not limited to checkpoint inhibitors (e.g., PD1, PDL1, CTLA4, and others described herein, kynureninase, adenosine degradation enzymes, are secreted via a Type V Auto-secreter (pic Protein) Secretion. In some embodiments, the therapeutic protein of interest is expressed as a fusion protein with the native Nissle auto-secreter E. coli_01635 (where the original passenger protein is replaced with the therapeutic polypeptides of interest.

In some embodiments, the therapeutic polypeptides of interest, e.g., IL-12, IL-2, IL-15, IL-18, IL-7, IL-21, CD40 agonist, CD40 agonist, CD226 agonist, CD137 agonist, ICOS agonist, OX040 agonist, GM-CSF, CXCL10, CXCL9, tryptophan and/or arginine synthesis enzymes, antibodies, e.g., scFvs, including but not limited to checkpoint inhibitors (e.g., PD1, PDL1, CTLA4, anti-LAGS, anti-TIM3 and others described herein, kynureninase, adenosine degradation enzyme, are secreted via Type I Hemolysin Secretion. In one embodiment, therapeutic polypeptide of interest is expressed as fusion protein with the 53 amino acids of the C terminus of alpha-hemolysin (hlyA) of E. coli CFT073.

Surface Display

In some embodiments, the genetically engineered bacteria and/or microorganisms encode one or more gene(s) and/or gene cassette(s) encoding an anti-cancer molecule which is anchored or displayed on the surface of the bacteria and/or microorganisms. Examples of the anti-cancer molecules which are displayed or anchored to the bacteria and/or microorganism, are any of the anti-cancer molecules described herein, and include but are not limited to antibodies, e.g., scFv fragments, and tumor-specific antigens or neoantigens. In a non-limiting example, the antibodies or scFv fragments which are anchored or displayed on the bacterial cell surface are directed against checkpoint inhibitors described herein, including, but not limited to, CLTLA4, PD-1, PD-L1.

In some embodiments, the genetically engineered bacteria comprise one or more gene sequence(s) encoding therapeutic polypeptide or effector molecule, e.g., a ScFv, which is anchored or displayed on the surface of the bacteria, and which remains anchored while exerting its effector function. In other embodiments, the genetically engineered bacteria encoding the surface-displayed therapeutic polypeptide, e.g., the antibodies or scFv fragments, lyse before, during or after exerting their effector function. In some embodiments, the genetically engineered bacteria encode a therapeutic peptide that is temporarily attached to the cell surface and which dissociates from the bacterium before, during, or after exerting its function.

In some embodiments, shorter peptides or polypeptides, e.g. peptides or polypeptides of less than 60 amino acids of length, are displayed on the cell surface of the genetically engineered bacteria. In some embodiments, such shorter peptides or polypeptides comprise an immune modulatory effector molecule. Non-limiting examples of such therapeutic polypeptides are described herein.

Several strategies for the display of shorter peptides or polypeptides on the surface of gram negative bacteria are known in the art, and are for example described in Georgiou et al., Display of heterologous proteins on the surface of microorganisms: from the screening of combinatorial libraries to live recombinant vaccines: Nat Biotechnol. 1997 January; 15(1):29-34, the contents of which is herein incorporated by reference in its entirety. These systems all share a common theme, targeting recombinant proteins to the cell surface by the construction of gene fusions using sequences from membrane-anchoring domains of surface proteins.

Non-limiting examples of such strategies are described in Table 15-17.

TABLE 15

Exemplary Cell Surface Display Strategies

| Carrier protein | Exemplary carrier organism | Type of fusion | Localization of heterologous polypeptide |
|---|---|---|---|
| LamB | E. coli | Sandwich fusion | Cell surface |
| PhoE | E. coli | Sandwich fusion | Cell surface |
| OprF | Pseudomonas | Sandwich fusion | Cell surface |
| Gram negative lipoproteins | E. coli | C-terminal or sandwich fusion | Periplasmic side or outer membrane/ Cell surface |
| Lpp-OmpA | E. coli | C-terminal fusion | Cell surface |
| VirG | Shigella | N-terminal fusion | Cell surface |
| IgA | Neisseria | N-terminal fusion | Cell surface |
| Flagellin (FliC) | E. coli | Sandwich fusion | Cell surface |
| Flagellin (FliC) | E. coli | Sandwich fusion | Cell surface |
| FimH (type I pili) | E. coli | Sandwich fusion | Cell surface |
| PapA (Pap pili) | E. coli | Sandwich fusion | Cell surface |
| PulA | Klebsiella | C-terminal fusion | Cell surface/ extracellular fluid |

TABLE 16

Exemplary Cell Surface Display Strategies

| Carrier | Passenger size |
|---|---|
| Outer membrane Proteins | |
| OmpA | 15-514 aa |
| OmprF | 17-43 aa |
| LamB | 11-232 aa |
| OmpS | 38-115 aa |
| OmpC | 162 aa |
| PhoE | 8-32 aa |
| Invasin | 18 aa |
| LppOmpA | < or = 40 kDa |
| Lipoproteins | |
| TraT | 11-98 aa |
| PAL | Approx.. 250 aa |
| OprI | 16 aa |
| Inp | Less than or equal 47 kDa |
| Autotransporters | |
| Igabeta | 12 kDa |
| VirGbeta | Approx.. 50 kDa |
| AIDA-1 | 12-40 kDa |
| Secreted | |
| Pullulanase | |
| Subunits of Surface | |
| Flagellae | 11-115 aa |
| Fimbriae | 7-52 aa |
| S-layer proteins | |
| RsaA | 12 aa |

TABLE 17

Exemplary Cell Surface Strategies

| Outer membrane protein | Type of fusion | Passenger size (kDa) |
|---|---|---|
| Outer membrane protein | | |
| eCPX derived from OmpX | Biterminal | 0.8-1.6 |
| FhuA | Insertional | 1.1-3.3 |
| LamB | Insertional | 1.2-25.5 |
| Omp1 | C-terminal | 56 |
| OmpA | Insertional | 1-50 |
| OmpC | Insertional, C-terminal | 18-52 |
| OmpT | | 35 |
| OprF | C-terminal | 50 |
| PgsA | C-terminal | 34-77 |
| Wza-omp orf1/OmpU/Omp26La | C-terminal | 27-50 |
| Surface Appendages | | |
| F Pillin | Insertional | 1.6 |
| Fimbria (FimH and FimA) | Insertional | 1-4 |
| Flagellin (FliC and FliD) | Insertional | 1.2-33 |
| Lipoproteins | | |
| INP | C-terminal | 7-119 |
| Lpp = OmpA | C-terminal | 27-74 |
| PAL | N-terminal | 29 |
| Tat-dependent lipoprotein | C-terminal | 27 |
| TraT | Insertional, C-terminal | 1.2-11 |
| Virulence Factors | | |
| AIDA-1 | N-terminal | 12-65 |
| EaeA | C-terminal | 3.9-31.6 |
| EspP | N-terminal | 20 |
| EstA | N-terminal | 38-60 |
| Invasin | C-terminal | 1.1 |
| MSP1a | N-terminal | 4.6 |

In some embodiments, the genetically engineered bacteria comprise one or more gene sequence(s) encoding one or more short therapeutic peptides or polypeptides fused into surface exposed loops of outer membrane proteins (OMPs), e.g., from enteric bacteria. In a non-limiting example, the short therapeutic peptides or polypeptides expressed by the genetically engineered bacteria are inserted into the outer membrane protein LamB, e.g., from *E. coli*, and displayed on the bacterial cell surface. Extracellular display of peptides through Insertion of peptides into surface exposed loops of LamB is for example described in Hofnung et al., Expression of foreign polypeptides at the *Escherichia coli* cell surface; Methods Cell Biol. 34:77-105, and Charbit, A. et al., 1987. Presentation of two epitopes of the preS2 region of hepatitis B virus on live recombinant bacteria, J. Immunol. 139:1658-1664.

In another non-limiting example, the short therapeutic peptides or polypeptides encoded by one or more gene sequence(s) comprised in the genetically engineered bacteria are inserted into the outer membrane protein PhoE, e.g., from *E. coli*, and displayed on the bacterial cell surface. The PhoE protein is another abundant outer membrane protein of *E. coli* K-12, which has a trimeric structure and functions as a pore for small molecules. Analysis of the primary structure of PhoE revealed 16 beta sheets which traverse through the membranes, and eight hypervariable regions exposed at the surface of the cell. One or more of these cell surface exposed regions of PhoE protein can be used to insert heterologous peptides. For example, antigenic determinants of pathogenic organisms have been presented in one or more cell surface exposed regions of PhoE protein (e.g., as described in Aterberg et al., 1990; Outer membrane PhoE protein of *Escherichia coli* as a carrier for foreign antigenic determinants: immunogenicity of epitopes of foot-and-mouth disease virus; Vaccine. 1990 February; 8(1):85-91).

In some embodiments, the genetically engineered bacteria comprise one or more gene sequence(s) encoding one or more short therapeutic peptides or polypeptides fused to protein components of extracellular appendages. Several systems have been described, in which extracellular appendages, such as pili and flagella are used to display peptides of interest at the bacterial cell surface. Examples of flagellar and pillar proteins used include FliC, a major structural component of the *E. coli* flagellum, and PapA, the major subunit of the Pap pilus. In one embodiment, the genetically engineered bacteria comprise one or more gene sequence(s) encoding one or more components of a FLITRX system. The FLITRX system is an *E. coli* display system based on the use of fusion protein of FliC and thioredoxin, a small redox protein which represents a highly versatile scaffold that allows peptide inserts to assume a confirmation compatible with binding to other proteins. In the FLITRX system, thioredoxin is fused into a dispensable region of FliC. Then, heterologous peptides can be inserted within the thioredoxin domain in the FliC fusion, and are surface exposed. Other scaffolding proteins are known in the art, some of which may replace thioredoxin as a scaffolding protein in this system.

In some embodiments, the genetically engineered bacteria comprise a FimH fusion protein, in which the therapeutic peptide of interest is fused to FimH, an adhesin of type 1 fimbriae, e.g., from *E. coli*. FimH adhesin chimeras containing as many as 56 foreign amino acids in certain positions are transported to the bacterial surface as components of the fimbrial organelles (Pallesen et al., Chimeric FimH adhesion of type I fimbriae: a bacterial surface display system for heterologous sequences. Microbiology 141: 2839-2848).

In some embodiments, the genetically engineered bacteria comprise one or more gene sequence(s) encoding a fusion protein in which the therapeutic peptide of interest is fused to the major subunit of F11 fimbriae, e.g., from *E. coli*. Hypervariable regions of the major subunit of F11 fimbriae can be used for insertion of heterologous peptides, e.g., antigenic epitopes (Van Die et al., Expression of foreign epitopes in P-fimbriae of *Escherichia coli*. Mol. Gen. Genet. 222: 297-303).

In one embodiment, the genetically engineered bacteria comprise one or more gene sequence(s) encoding a papA fusion protein, in which the therapeutic peptide of interest is fused to papA. In some embodiments, peptides of interest are inserted following either codon 7 or 68 of the coding sequence for the mature portion of PapA, as peptides in the area of amino acids 7 and 68 of PapA are localized at the external side of the pilus (Steidler et al., Pap pili as a vector system for surface exposition of an immunoglobulin G-binding domain of protein A of *Staphylococcus aureus* in *Escherichia coli*; J Bacteriol. 1993 December; 175(23): 7639-43).

In some embodiments, the genetically engineered bacteria comprise one or more gene sequence(s), which encode polypeptides larger than 60 amino acids, e.g., immune modulatory effector, and which are displayed on the bacterial cell surface. In some embodiments, the genetically engineered bacteria comprise one or more gene sequence(s), which encode a fusion protein, in which a therapeutic peptide of interest, e.g., a polypeptide greater than 60 amino acids in length, is fused to a lipoprotein from a gram negative bacterium, or one or more fragments thereof.

In one embodiment, the genetically engineered bacteria comprise one or more gene sequence(s), which encode a fusion protein, in which a therapeutic protein of interest is fused to peptidoglycan associated lipoprotein (PAL) or a fragment thereof. The fusion protein in located in the periplasm and can be displayed externally upon permeabilization of the outer membrane. For example, a PAL-scFv fusion protein was shown to bind its antigen and to be tightly bound to the murein layer of the cell envelope (Fuchs et al., Targeting recombinant antibodies to the surface of *Escherichia coli* fusion to a peptidoglycan-associated lipoprotein; Biotechnology (NY). 1991 December; 9(12):1369-72). The PAL-scFv fusion was located in the periplasm and bound to the murein layer, and after permeabilization of the outer membrane, the scFv became accessible to externally added antigen. In some embodiments, the genetically engineered bacteria comprising a fusion protein for surface display further have a permeable outer membrane. Mutations and/or deletions resulting in a leaky outer membrane are described elsewhere herein.

In one embodiment, the genetically engineered bacteria encode a fusion protein, in which a therapeutic protein of interest, e.g., an immune modulatory effector, is fused to residues of the major lipoprotein of a gram negative bacterium, e.g., *E. coli*. In one embodiment, the genetically engineered bacteria encode a fusion protein, in which a therapeutic protein of interest, is fused to the signal peptide and the nine N-terminal amino acid residues of the major lipoprotein of a gram negative bacterium, e.g., *E. coli*. These residues of the *E. coli* major lipoprotein function as a hydrophobic membrane anchor. For example, a fusion construct of these residues with a therapeutic polypeptide, in this case a scFv fragment, resulted in specific accumulation of an immunoreactive and cell-bound polypeptide in *E. coli* (Laukkanen et al., Lipid-tagged antibodies: bacterial expression and characterization of a lipoprotein-single-chain antibody fusion protein. Mol. Microbiol. 4:1259-1268).

In one embodiment, the genetically engineered bacteria encode a fusion protein, in which a therapeutic protein of interest, is inserted into the TraT protein of a gram negative bacterium, e.g., *E. coli*, e.g. at position 180. The TraT protein is a surface-exposed lipoprotein, specified by plasmids of the IncF group, that mediates serum resistance and surface exclusion. Taylor et al. showed that insertion of the C3 epitope of polio virus, e.g., at position 180, allowed exposure of the antigen to the cell surface, while the oligomeric conformation of the wild-type protein was maintained (Taylor et al., The TraT lipoprotein as a vehicle for the transport of foreign antigenic determinants to the cell surface of *Escherichia coli* K12: structure-function relationship in the TraT protein. Mol Microbiol. 1990 August; 4(8):1259-68).

In one embodiment, the genetically engineered bacteria comprise one or more genes and/or gene cassettes encoding a fusion protein comprising a Lpp-OmpA display vehicle comprising the N terminal outer membrane signal from the major lipoprotein (Lpp) fused to a domain from the outer membrane protein OmpA, fused to the therapeutic polypeptide of interest. In this system, the Lpp signal peptide mediates localization, and OmpA provides the framework for the display of the therapeutic protein of interest. Lpp-OmpA fusions have been used to display several proteins between 20 and 54 kDa in size on the surface of *E. coli* (see, e.g., Staphopoulos et al., Characterization of *Escherichia coli* expressing and Lpp-OmpA (46-159)-PhoA fusion protein localized in the outer membrane). For example, Fransco et al fused beta-lactamase to the N-terminal targeting sequence of Lpp and an OmpA fragment containing 5 of the 8 membrane spanning loops of the native protein. This fusion protein was assembled on the cell surface and the beta-lactamase domain was stably anchored in the cell wall (Fransisco et al., Transport and anchoring of beta-lactamase to the external surface of *Escherichia coli*; Proc. Natl. Acad. Sci. USA Vol 89, pp. 2713-2717, 1992).

In one embodiment, the Type II secretion pathway or a variation thereof is used to for transient or longer duration display of therapeutic proteins of interest on the bacterial cell surface, e.g., the IgA protease secretion pathway of *Neisseria* or the VirG protein pathway of *Shigella*. In one embodiment, the IgA protease secretion pathway is used to export and display therapeutic peptides of interest on the cell surface of gram negative bacteria. The IgA proteases of *Neisseria gonorrhoeae* and Hemophilus influenza use a variation of the most common, Type II secretion pathway, to achieve extracellular export independent of any other gene products. The IgA genes of *Neisseria* species encode extracellular proteins that cleave human IgA1 antibody. The iga gene alone is sufficient to direct selected extracellular secretion of IgA protease in *Neisseria, Salmonella*, and *E. coli* species (Klauser et al., 1993, Extracellular transport of cholera toxin B subunit using *Neisseria* IgA protease beta-domain: conformation-dependent outer membrane translocation. EMBO J 9:1991-1999, and references therein). The mature IgA protease is processed in several steps from a large precursor by signal peptidase and autoproteolytic cleavage. The precursor consists of four domains: (1) an amino terminal signal peptide which mediates inner membrane transport; (2) the protease domain (3) the alpha domain, a basic alpha helical region which is secreted with the protease and (4) the autotransporter beta domain which harbors the essential function for outer membrane transport. Essentially, the C-terminal beta autotransporter domain of the IgA protease forms a channel in the outer membrane that mediates the export of the N terminal domain across the membrane, which in turn becomes transiently displayed on the external surface of the bacteria. The alpha domain and protease domain are then released through proteolytic cleavage. Klauser et al. (1993), showed that replacement of the native N-terminal domains of IgA protease of *N. gonorrhoeae* with the cholera toxin B resulted in the surface presentation of the passenger polypeptide in *S. typhymurium*. In another study, the signal sequence and the C-terminal beta autotransporter domain of the IgA protease of *Neisseria gonorrhoeae* was used to translocate and display a scFv directed against a porcine epidemic diarrhea virus epitope on the bacterial cell surface of *E. coli* (Pyo et al., *Escherichia coli* expressing single chain Fv on the cell surface as a potential prophylactic of porcine epidemic diarrhea virus; Vaccine (27) (2009) 2030-2036.).

Thus, in one embodiment, the genetically engineered bacteria encode a IgA protease fragment in which the alpha domain is substituted with a therapeutic protein of interest, and fused to a functional IgA protease beta-domain, which mediates export through the outer membrane. Without wishing to be bound by theory, IgA protease activity is eliminated in such a fusion protein, and therefore the autoproteolytic release of the fusion protein into the medium does not occur, resulting in the display of the therapeutic protein of interest on the cell surface of the gram-negative host bacterium.

The secretion of VirG protein from *Shigella* is similar to the export system utilized by the IgA protease of *Neisseria* (see., e.g., Suzuki et al., 1995; Extracellular transport of VirG protein in *Shigella* J Biol. Chem 270:30874-30880, and references therein). Thus, in some embodiments, the genetically engineered bacteria encode a fusion protein comprising a therapeutic protein of interest fused to the membrane spanning region of VirG, resulting in surface display of the therapeutic protein of interest. The VirG gene on the large plasmid of *Shigella* has been shown to be responsible for the localized deposition of filamentous actin (F-actin) trailing from one pole of invading bacterial cells and extending in a filament through the host epithelial cytoplasm. VirG is a surface-exposed outer membrane protein consisting of three distinctive domains, the N-terminal signal sequence (amino acids 1-52), the id a-domain (amino acids 53-758), and the dC-terminal β-core (amino acids 759-1102) (see, e.g., Suzuki et al., 1996; Functional Analysis of *Shigella* VirG Domains Essential for Interaction with Vinculin and Actin-based Motility; J. Biol. Chem., 271, 21878-21885, and references therein). Suzuki et al. (1995); showed that the fusion of a foreign protein such as MalE or PhoA protein to the N terminus 37-kDa VirG portion resulted in the transport of the passenger polypeptides from the periplasm to the external side of the outer membrane, indicating that the C-terminal 37-kDa VirG portion embedded in the outer membrane is involved in the translocation of the preceding VirG portion or the heterologous or passenger polypeptide from the periplasmic space to the external side of the outer membrane, in a manner homologous to the IgA protease beta-domain. In some embodiments, the genetically engineered bacteria comprise one or more gene(s) or gene cassette(s) encoding a fusion protein, in which a C-terminal 37-kDa VirG protein fragment is fused to a therapeutic protein of interest.

In some embodiments, the genetically engineered bacteria comprise one or more gene(s) or gene cassette(s) encoding a fusion protein, in which a therapeutic protein of interest is fused to pullulanase for temporary surface display. Pullulanase is specifically released into the medium by *Klebsiella pneumoniae*, and exists as a fully exposed, cell surface-bound intermediate before it is released into the medium from early stationary growth phase onwards. Cell-surface anchoring is accomplished by an N-terminal fatty acyl modification whose chemical composition is identical to that of other bacterial protein.

Unlike the IgA protease, the lipoprotein pullulanase (PulA) of *Klebsiella pneumoniae*, which is also exported via a type II secretion mechanism, requires 14 genes for its translocation across the outer membrane. For example, Pugsley and coworkers have shown that the lipoprotein pullulanase (PulA) can facilitate translocation of the periplasmic enzyme beta-lactamase across the outer membrane. In particular, in *E. coli* strains expressing all pullulanase secretion genes, pullulanase-beta-lactamase hybrid protein molecules containing an N-terminal 834-amino-acid pullulanase segment were efficiently transported to the cell surface. Of note, pullulanase hybrids remain only temporarily attached to the bacterial surface and are subsequently released into the medium (Kornacker and Pugsley: The normally periplasmic enzyme beta-lactamase is specifically and efficiently translocated through the *Escherichia coli* outer membrane when it is fused to the cell surface enzyme pullulanase. Mol. Microbiol. 4:1101-1109, and references therein). Accordingly, in some embodiments, the genetically engineered bacteria comprise one or more gene sequence(s) comprising a complete set of pullulanase genes required for secretion and fusion protein comprising a therapeutic protein of interest fused to a N-terminal pullulanase polypeptide fragment, e.g., as described by Kornacker and Pugsley. In some embodiments, the fusion proteins comprising N-terminal pullulanase polypeptide fused to the therapeutic protein of interest, are transiently displayed on the surface of the bacterial cell, and subsequently released into the media or extracellular space.

In one embodiment, the genetically engineered bacteria comprise one or more gene(s) or gene cassette(s) encoding a fusion protein in which the ice nucleation protein (INP) from *Pseudomonas syringae* anchors a therapeutic protein of interest in the cell wall. INP is a secretory protein that catalyzes extracellular ice formation as the ice nuclei. INP has been found in a number of Gram-negative species, including *P. syringae, Erwinia herbicola, Xanthomonas campestris*, and *Pseudomonas fluorescens*. Four genes in *P. syringae* strains, inaK, inaV, and inaZ, and inaQ exhibit high similarities in sequences and in primary organization (Li et al., Molecular Characterization of an Ice Nucleation Protein Variant (InaQ) from *Pseudomonas syringae* and the Analysis of Its Transmembrane Transport Activity in *Escherichia coli* Int J Biol Sci. 2012; 8(8): 1097-1108). All INPs (1200 aa to 1500 aa) comprise of three distinct structural domains: (1) the N-terminal domain (approximately 15% of the total sequence), which is relatively hydrophobic and which is are potentially capable of being coupled to the mannan-phosphatidylinositol group in the outer membrane through N-glycan (Asp) or O-glycan (Ser, Thr) linkages; (2) the C-terminal domain (approximately 4%), which is a relatively hydrophilic terminus; and (3) the central repeating domain (CRD) (approximately 81%), which constitutes contiguous repeats given by 16-residue (or 48-residue) periodicities with a consensus octapeptide (Ala-Gly-Tyr-Gly-Ser-Thr-Leu-Thr) (SEQ ID NO: 1251). INPs have been employed in various bacterial cell-surface display systems including *E. coli, Zymomonas mobilis, Salmonellas* sp., *Vibrio anguillarum, Pseudomonas putida*, and cyanobacteria, in all of which INPs were able to target a heterologous protein onto the surface of the host cell. Moreover, the N-terminal region alone was shown to direct translocation of foreign proteins to the cell surface and can be employed as a potential cell surface display motif (Li et al., 2004 Functional display of foreign protein on surface of *Escherichia coli* using N-terminal domain of ice nucleation protein; Biotechnol Bioeng. 2004 Jan. 20; 85(2):214-21). Accordingly, in some embodiments, the genetically engineered bacteria comprise IMP fusions for surface display of a therapeutic peptide of interest. In some embodiments, the N-terminal region of the INP protein is fused to the polypeptide of interest for surface display.

IMP proteins further have modifiable internal repeating units, i.e., CRD length is adjustable, which is allows flexibility in protein fusion length (Jung et al., 1998), and also can accommodate larger polypeptides. For example, the INP-based display systems were used to successfully express a 90 kDA protein on the cell surface of *E. coli* (Wu et al., 2006; Cell surface display of Chi92 on *Escherichia coli* using ice nucleation protein for improved catalytic and antifungal activity; FEMS Microbiology Letters, Volume 256, Issue 1; Pages 119-125).

It is understood by those skilled in the art that translocation of such fusion or hybrid proteins described herein requires a "translocation-competent" conformation, e.g., the formation of disulfide bonds, e.g., in the periplasmic space, may be undesirable and inhibit translocation through the outer membrane (see, e.g., Klauser et al., 1990), or alternatively may be required for, (or at least not impede) translocation through the outer membrane (see, e.g., Puggsley, 1992; Translocation of a folded protein across the outer membrane in *Escherichia coli*; Proc Natl Acad Sci USA. 1992 Dec. 15; 89(24): 12058-12062). In some embodiments, the genetically engineered bacteria comprise one or more gene sequence(s) encoding for a fusion protein in which disulfide bonds are prevented from forming prior to the translocation to the cell surface. In some embodiments, the genetically engineered bacteria comprise one or more gene(s) or gene cassette(s) encoding for a fusion protein in which disulfide bonds are formed prior to translocation to the cell surface.

Expression systems for the display of proteins in Gram-positive bacteria have also been developed. Consequently, in some embodiments, gram positive bacteria are engineered to display therapeutic proteins of interest on their cell surface. Uhlen et al. used fusions to the cell-wall bound, X-domain of protein A, for the display of foreign peptides up to 88 amino acids long to the surface of *Staphylococcus* strains. For example, one study describes an expression system to allow targeting of heterologous proteins to the cell surface of *Staphylococcus* xylosus, a coagulase-negative gram-positive bacterium (Hansson et al., Expression of recombinant proteins on the surface of the coagulase-negative bacterium *Staphylococcus* xylosus; J Bacteriol. 1992 July; 174(13): 4239-45).

The expression of recombinant gene fragments, fused between gene fragments encoding the signal peptide and the cell surface-binding regions of staphylococcal protein A, targets the resulting fusion proteins to the outer bacterial cell surface via the membrane-anchoring region and the highly charged cell wall-spanning region of staphylococcal protein A. Accordingly, in some embodiments, the genetically engineered bacteria comprise one or more gene sequences encoding a therapeutic polypeptide fused between gene fragments encoding the signal peptide and the cell surface-binding regions of staphylococcal protein A

*E. coli-staphylococcus* shuttle vectors have been constructed by taking advantage of the promoter, signal sequence, and propeptide region from the lipase gene construct derived from *S. hyicus* and the cell surface attachment part of staphylococcal protein A. This system has been investigated for the surface display of heterologous polypeptides on *S. carnosus* (Samuelson et al., Cell surface display of recombinant proteins on *Staphylococcus carnosus*; J Bacteriol. 1995 March; 177(6):1470-6). In some embodiments, the genetically engineered bacteria comprise one or more gene sequence(s) encoding a therapeutic polypeptide fusion protein comprising promoter, signal sequence, and propeptide region from the lipase gene construct derived from *S. hyicus* and the cell surface attachment part of staphylococcal protein A.

In other studies, the fibrillary M6 proteins of *Streptococcus* pyrogens was employed as a carrier for antigen delivery in *Streptococcus* cells. (Pozzi et al., 1992; Delivery and expression of a heterologous antigen on the surface of streptococci. Infect. Immunm. 60: 1902-1907). In some embodiments, the genetically engineered bacteria comprise one or more gene sequence(s) comprising therapeutic polypeptide fusion proteins comprising the fibrillary M6 proteins of *Streptococcus* pyrogens for cell surface display of the therapeutic polypeptide.

In some embodiments, the genetically engineered bacteria comprise one or more gene(s) or gene cassette(s) encoding a polypeptide of interest which is displayed on the cell surface through a fusion with an intimin or invasin. Intimins and invasins belong to a family of bacterial adhesins which specifically interact with various eukaryotic cell surface receptors, thereby mediating bacterial adherence and invasion. Both intimins and invasins provide a structural scaffold ideally suited to the cell surface display.

In some embodiments, the genetically engineered bacteria comprise one or more gene(s) or gene cassette(s) encoding a polypeptide of interest which is displayed on the cell surface through a fusion with an intimin, e.g., with the Enterohemorragic *E. coli* Intimin EaeA protein or a carboxy-terminal truncation thereof (e.g., as described in Wentzel et al, Display of Passenger Proteins on the Surface of *Escherichia coli* K-12 by the Enterohemorrhagic *E. coli* Intimin EaeA J Bacteriol. 2001 December; 183(24): 7273-7284). For example, N-terminal 489 amino acids of invasin are sufficient to promote the localization of a fusion protein to the cell surface.

In some embodiments, the genetically engineered bacteria comprise one or more gene(s) or gene cassette(s) encoding a polypeptide of interest which is displayed on the cell surface through a fusion with an invasin, e.g. Enterohemorrhagic *E. coli* invasion, or a carboxyterminal truncation thereof. For example, N-terminal 539 amino acids of intimin were sufficient to promote outer membrane localization of a fusion protein (Liu et al., The Tir-binding region of enterohaemorrhagic *Escherichia coli* intimin is sufficient to trigger actin condensation after bacterial-induced host cell signaling; Mol Microbiol. 1999 October; 34(1):67-81).

In some embodiments, the genetically engineered bacteria comprise one or more gene(s) or gene cassette(s) encoding a polypeptide of interest which is displayed on the cell surface through a fusion with *Bacillus anthracis* exosporal protein (BclA) as an anchoring motif. The BclA is an exosporium protein, a hair-like protein surrounding the *B. anthracis* spore. In a nonlimiting example, a polypeptide of interest is linked to the C-terminus of N-terminal domain (21 amino acids) of BclA, e.g., as described in Park et al. (Surface display of recombinant proteins on *Escherichia coli* by BclA exosporium of *Bacillus anthracis*).

Various other anchoring motifs have been developed including OprF, OmpC, and OmpX. In some embodiments, the genetically engineered bacteria comprise one or more gene(s) or gene cassette(s) encoding a polypeptide of interest which is displayed on the cell surface through a fusion with OprF, OmpC, and OmpX.

In some embodiments, the therapeutic polypeptides of interest are permanently displayed on the cell surface of the genetically engineered bacterium. In some embodiments, the therapeutic polypeptides of interest are transiently displayed on the cell surface of the genetically engineered bacterium.

In some embodiments, the therapeutic polypeptides are displayed in strains, e.g., described herein which display a leaky phenotype. Such strains have deactivating mutations in one or more of genes encoding a protein that tethers the outer membrane to the peptidoglycan skeleton, e.g., lpp, ompC, ompA, ompF, tolA, tolB, pal, and/or one or more genes encoding a periplasmic protease, e.g., degS, degP, nlpI.

In some embodiments, the genetically engineered bacteria comprise a gene sequence encoding a therapeutic polypeptide comprising an invasin display tag. In one embodiment, the genetically engineered bacteria comprise a gene sequence encoding a polypeptide comprising SEQ ID NO: 990.

In some embodiments, the genetically engineered bacteria comprise a gene sequence encoding a therapeutic polypeptide comprising an LppOmpA display tag. In one embodiment, the genetically engineered bacteria comprise a gene sequence encoding a polypeptide comprising SEQ ID NO: 991.

In some embodiments, the genetically engineered bacteria comprise a gene sequence encoding a therapeutic polypeptide comprising an intimin N display tag. In one embodiment, the genetically engineered bacteria comprise a gene sequence encoding a polypeptide comprising SEQ ID NO: 992.

In some embodiments, the genetically engineered bacteria comprise a display anchor which is at least about 80%, at least about 85%, at least about 90%, at least about 95%, or at least about 99% homologous to a sequence selected from SEQ ID NO: 990, SEQ ID NO: 991, and SEQ ID NO: 992. In another embodiment, the genetically engineered bacteria comprise a gene sequence encoding display anchor comprising a sequence selected from SEQ ID NO: 990, SEQ ID NO: 991, and SEQ ID NO: 992. In yet another embodiment, the display anchor expressed by the genetically engineered bacteria consists of a sequence selected from SEQ ID NO: 990, SEQ ID NO: 991, and SEQ ID NO: 992.

In some embodiments, one or more ScFvs are displayed on the bacterial cell surface, alone or in combination with other therapeutic polypeptides of interest.

In some embodiments, a cell surface display strategy or circuit is combined with a secretion strategy or circuit in one bacterium. In some embodiments, the same polypeptide is both displayed and secreted. In some embodiments, a first polypeptide is displayed and a second is secreted. In some embodiments, a display strategy or circuit strategy is combined with a circuit for the intracellular production of an enzyme and consequentially intracellular catabolism of its substrate. In some embodiments, a display strategy or display circuit is combined with a circuit for the intracellular production of a gut barrier enhancer molecule and/or an anti-inflammatory effector molecule.

In some embodiments, the expression of the surface displayed polypeptide or fusion protein is driven by an inducible promoter. In some embodiments, the inducible promoter is an oxygen level-dependent promoter (e.g., FNR-inducible promoter). In some embodiments, the inducible promoter is induced by gut-specific and/or tumor-specific or promoters induced by inflammation or an inflammatory response (RNS, ROS promoters), or promoters induced by a metabolite that may or may not be naturally present (e.g., can be exogenously added) in the gut, e.g., arabinose. In alternate embodiments, expression of the surface displayed polypeptides or polypeptide fusion proteins is driven by a constitutive promoter.

In some embodiments, the expression of the surface displayed polypeptide or fusion protein is plasmid based. In some embodiments, the gene sequence(s) encoding the antibodies or scFv fragments for surface display is chromosomally inserted.

Essential Genes, Auxotrophs, Kill Switches, and Host-Plasmid Dependency

As used herein, the term "essential gene" refers to a gene that is necessary to for cell growth and/or survival. Bacterial essential genes are well known to one of ordinary skill in the art, and can be identified by directed deletion of genes and/or random mutagenesis and screening (see, for example, Zhang and Lin, 2009, DEG 5.0, a database of essential genes in both prokaryotes and eukaryotes, Nucl. Acids Res., 37:D455-D458 and Gerdes et al., Essential genes on metabolic maps, Curr. Opin. Biotechnol., 17(5):448-456, the entire contents of each of which are expressly incorporated herein by reference).

In other embodiments, auxotrophic modifications may also be used to screen for mutant bacteria that produce the anti-cancer molecule.

An "essential gene" may be dependent on the circumstances and environment in which an organism lives. For example, a mutation of, modification of, or excision of an essential gene may result in the recombinant bacteria of the disclosure becoming an auxotroph. An auxotrophic modification is intended to cause bacteria to die in the absence of an exogenously added nutrient essential for survival or growth because they lack the gene(s) necessary to produce that essential nutrient.

An auxotrophic modification is intended to cause bacteria to die in the absence of an exogenously added nutrient essential for survival or growth because they lack the gene(s) necessary to produce that essential nutrient. In some embodiments, any of the genetically engineered bacteria described herein also comprise a deletion or mutation in a gene required for cell survival and/or growth. In one embodiment, the essential gene is a DNA synthesis gene, for example, thyA. In another embodiment, the essential gene is a cell wall synthesis gene, for example, dapA. In yet another embodiment, the essential gene is an amino acid gene, for example, serA or MetA. Any gene required for cell survival and/or growth may be targeted, including but not limited to, cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thiI, as long as the corresponding wild-type gene product is not produced in the bacteria. Exemplary bacterial genes which may be disrupted or deleted to produce an auxotrophic strain as described in International Patent Application PCT/US2017/013072, filed Jan. 11, 2017, published as WO2017/123675, the contents of which is herein incorporated by reference in its entirety. These include, but are not limited to, genes required for oligonucleotide synthesis, amino acid synthesis, and cell wall synthesis. A non-limiting example of the process of introducing a ThyA auxotrophy is described in Example 63 of Patent Application PCT/US2017/013072, filed Jan. 11, 2017, published as WO2017/123675, the contents of which is herein incorporated by reference in its entirety.

In some embodiments, the genetically engineered bacterium of the present disclosure is a synthetic ligand-dependent essential gene (SLiDE) bacterial cell. SLiDE bacterial cells are synthetic auxotrophs with a mutation in one or more essential genes that only grow in the presence of a particular ligand (see Lopez and Anderson "Synthetic Auxotrophs with Ligand-Dependent Essential Genes for a BL21 (DE3 Biosafety Strain, "ACS Synthetic Biology (2015) DOI: 10.1021/acssynbio.5b00085, the entire contents of which are expressly incorporated herein by reference).

In some embodiments, the SLiDE bacterial cell comprises a mutation in an essential gene. In some embodiments, the essential gene is selected from the group consisting of pheS, dnaN, tyrS, metG, and adk. In some embodiments, the essential gene is dnaN comprising one or more of the following mutations: H191N, R240C, I317S, F319V, L340T, V347I, and S345C. In some embodiments, the essential gene is dnaN comprising the mutations H191N, R240C, I317S, F319V, L340T, V347I, and S345C. In some embodiments, the essential gene is pheS comprising one or more of the following mutations: F125G, P183T, P184A, R186A, and I188L. In some embodiments, the essential gene is pheS comprising the mutations F125G, P183T, P184A, R186A, and I188L. In some embodiments, the essential gene is tyrS comprising one or more of the following mutations: L36V, C38A, and F40G. In some embodiments, the essential gene is tyrS comprising the mutations L36V, C38A, and F40G. In some embodiments, the essential gene is metG comprising one or more of the following mutations: E45Q, N47R, I49G, and A51C. In some embodiments, the essential gene is metG comprising the mutations E45Q, N47R, I49G, and A51C. In some embodiments, the essential gene is adk comprising one or more of the following mutations: I4L, L5I, and L6G. In some embodiments, the essential gene is adk comprising the mutations I4L, L5I, and L6G.

In some embodiments, the genetically engineered bacterium is complemented by a ligand. In some embodiments, the ligand is selected from the group consisting of benzothiazole, indole, 2-aminobenzothiazole, indole-3-butyric acid, indole-3-acetic acid, and L-histidine methyl ester. For example, bacterial cells comprising mutations in metG (E45Q, N47R, I49G, and A51C) are complemented by benzothiazole, indole, 2-aminobenzothiazole, indole-3-butyric acid, indole-3-acetic acid or L-histidine methyl ester. Bacterial cells comprising mutations in dnaN (H191N, R240C, I317S, F319V, L340T, V347I, and S345C) are complemented by benzothiazole, indole or 2-aminobenzothiazole. Bacterial cells comprising mutations in pheS (F125G, P183T, P184A, R186A, and I188L) are complemented by benzothiazole or 2-aminobenzothiazole. Bacterial cells comprising mutations in tyrS (L36V, C38A, and F40G) are complemented by benzothiazole or 2-aminobenzothiazole. Bacterial cells comprising mutations in adk (I4L, L5I, and L6G) are complemented by benzothiazole or indole.

In some embodiments, the genetically engineered bacterium comprises more than one mutant essential gene that renders it auxotrophic to a ligand. In some embodiments, the bacterial cell comprises mutations in two essential genes. For example, in some embodiments, the bacterial cell comprises mutations in tyrS (L36V, C38A, and F40G) and metG (E45Q, N47R, I49G, and A51C). In other embodiments, the bacterial cell comprises mutations in three essential genes. For example, in some embodiments, the bacterial cell comprises mutations in tyrS (L36V, C38A, and F40G), metG (E45Q, N47R, I49G, and A51C), and pheS (F125G, P183T, P184A, R186A, and I188L).

In some embodiments, the genetically engineered bacteria of the invention also comprise a kill switch. Suitable kill switches are described in International Patent Application PCT/US2016/39427, filed Jun. 24, 2016, published as WO2016/210373, the contents of which are herein incorporated by reference in their entirety. The kill switch is intended to actively kill engineered microbes in response to external stimuli. As opposed to an auxotrophic mutation where bacteria die because they lack an essential nutrient for survival, the kill switch is triggered by a particular factor in the environment that induces the production of toxic molecules within the microbe that cause cell death.

In some embodiments, the genetically engineered bacteria of the invention also comprise a plasmid that has been modified to create a host-plasmid mutual dependency. In certain embodiments, the mutually dependent host-plasmid platform is as described in Wright et al., 2015. In some embodiments, the biosafety systems comprise plasmid based and chromosomally integrated components. In non-limiting examples, plasmid based components may comprise one or more gene sequences selected from SEQ ID NO: 997-1001 or polypeptide sequences selected from SEQ ID NO: 1002-1004, and chromosomally integrated components may comprise one or more gene sequences selected from SEQ ID NO: 1005-1010. These and other systems and platforms are described in International Patent Application PCT/US2017/013072, filed Jan. 11, 2017, published as WO2017/123675, the contents of which is herein incorporated by reference in its entirety. In one embodiment, a genetically engineered bacterium, comprises one or more biosafety constructs integrated into the bacterial chromosome in combination with one or more biosafety plasmid(s). In some embodiments, the plasmid comprises a conditional origin of replication (COR), for which the plasmid replication initiator protein is provided in trans, i.e., is encoded by the chromosomally integrated biosafety construct. In some embodiments, the chromosomally integrated construct is further introduced into the host such that an auxotrophy results (e.g., dapA or thyA auxotrophy), which in turn is complemented by a gene product expressed from the biosafety plasmid construct. In some embodiments, the biosafety plasmid further encodes a broad-spectrum toxin (e.g., Kis), while the integrated biosafety construct encodes an anti-toxin (e.g., anti-Kis), permitting propagation of the plasmid in the bacterial cell containing both constructs.

In any of the embodiments, described herein, the genetically engineered microorganisms comprise gene sequences or mutations which provide one or more regulatory mechanisms, e.g., for containment, selected from an auxotrophy a kill switch or a host-plasmid dependency.

Genetic Regulatory Circuits

In some embodiments, the genetically engineered bacteria comprise multilayered genetic regulatory circuits for expressing the constructs described herein. Suitable multilayered genetic regulatory circuits are described in International Patent Application PCT/US2016/39434, filed on Jun. 24, 2016, published as WO2016/210378, the contents of which is herein incorporated by reference in its entirety. The genetic regulatory circuits are useful to screen for mutant bacteria that produce an anti-cancer molecule or rescue an auxotroph. In certain embodiments, the invention provides methods for selecting genetically engineered bacteria that produce one or more genes of interest.

Pharmaceutical Compositions and Formulations

Pharmaceutical compositions comprising the genetically engineered microorganisms of the invention may be used to treat, manage, ameliorate, and/or prevent cancer. Pharmaceutical compositions of the invention comprising one or more genetically engineered bacteria, and/or one or more genetically engineered OVs, alone or in combination with prophylactic agents, therapeutic agents, and/or pharmaceutically acceptable carriers are provided.

In certain embodiments, the pharmaceutical composition comprises one species, strain, or subtype of bacteria that are engineered to comprise the genetic modifications described herein, e.g., one or more genes encoding one or more anti-cancer molecules. In alternate embodiments, the pharmaceutical composition comprises two or more species, strains, and/or subtypes of bacteria that are each engineered to comprise the genetic modifications described herein, e.g., one or more genes encoding one or more anti-cancer molecules.

In some embodiments, the genetically engineered bacteria are administered systemically or intratumorally as spores. As a non-limiting example, the genetically engineered bacteria are Clostridia, and administration results in a selective colonization of hypoxic/necrotic areas within the tumor. In some embodiments, the spores germinate exclusively in the hypoxic/necrotic regions present in solid tumors and nowhere else in the body.

The pharmaceutical compositions of the invention may be formulated in a conventional manner using one or more physiologically acceptable carriers comprising excipients and auxiliaries, which facilitate processing of the active ingredients into compositions for pharmaceutical use. Methods of formulating pharmaceutical compositions are known in the art (see, e.g., "Remington's Pharmaceutical Sciences," Mack Publishing Co., Easton, Pa.). In some embodiments, the pharmaceutical compositions are subjected to tableting, lyophilizing, direct compression, conventional mixing, dissolving, granulating, levigating, emulsifying, encapsulating, entrapping, or spray drying to form tablets, granulates, nanoparticles, nanocapsules, microcapsules, microtablets, pellets, or powders, which may be enterically coated or uncoated. Appropriate formulation depends on the route of administration.

The genetically engineered microorganisms may be formulated into pharmaceutical compositions in any suitable dosage form (e.g., liquids, capsules, sachet, hard capsules, soft capsules, tablets, enteric coated tablets, suspension powders, granules, or matrix sustained release formations for oral administration) and for any suitable type of administration (e.g., oral, topical, injectable, intravenous, subcutaneous, intratumoral, peritumor, immediate-release, pulsatile-release, delayed-release, or sustained release). Suitable dosage amounts for the genetically engineered bacteria may range from about $10^4$ to $10^{12}$ bacteria. The composition may be administered once or more daily, weekly, or monthly. The composition may be administered before, during, or following a meal. In one embodiment, the pharmaceutical composition is administered before the subject eats a meal. In one embodiment, the pharmaceutical composition is administered currently with a meal. In on embodiment, the pharmaceutical composition is administered after the subject eats a meal.

The genetically engineered bacteria or genetically engineered virus may be formulated into pharmaceutical compositions comprising one or more pharmaceutically acceptable carriers, thickeners, diluents, buffers, buffering agents, surface active agents, neutral or cationic lipids, lipid complexes, liposomes, penetration enhancers, carrier compounds, and other pharmaceutically acceptable carriers or agents. For example, the pharmaceutical composition may include, but is not limited to, the addition of calcium bicarbonate, sodium bicarbonate, calcium phosphate, various sugars and types of starch, cellulose derivatives, gelatin, vegetable oils, polyethylene glycols, and surfactants, including, for example, polysorbate 20. In some embodiments, the genetically engineered bacteria of the invention may be formulated in a solution of sodium bicarbonate, e.g., 1 molar solution of sodium bicarbonate (to buffer an acidic cellular environment, such as the stomach, for example). The genetically engineered bacteria may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The genetically engineered microorganisms may be administered intravenously, e.g., by infusion or injection. Alternatively, the genetically engineered microorganisms may be administered intratumorally and/or peritumorally. In other embodiments, the genetically engineered microorganisms may be administered intra-arterially, intramuscularly, or intraperitoneally. In some embodiments, the genetically engineered bacteria colonize about 20%, 30%, 40%, 50%, 60%, 70%, 80%, 90% or more of the tumor. In some embodiments, the genetically engineered bacteria are co-administered with a PEGylated form of rHuPH20 (PEGPH20) or other agent in order to destroy the tumor septae in order to enhance penetration of the tumor capsule, collagen, and/or stroma. In some embodiments, the genetically engineered bacteria are capable of producing an anti-cancer molecule as well as one or more enzymes that degrade fibrous tissue.

The genetically engineered microorganisms of the disclosure may be administered via intratumoral injection, resulting in bacteria or virus that is directly deposited within the target tumor. Intratumoral injection of the engineered bacteria or virus may elicit a potent localized inflammatory response as well as an adaptive immune response against tumor cells. Bacteria or virus are suspended in solution before being withdrawn into a 1-ml syringe. In some embodiments, the tumor is injected with an 18-gauge multipronged needle (Quadra-Fuse, Rex Medical). The injection site is aseptically prepared. If available, ultrasound or CT may be used to identify a necrotic region of the tumor for injection. If a necrotic region is not identified, the injection can be directed to the center of the tumor. The needle is inserted once into a predefined region, and dispensed with even pressure. The injection needle is removed slowly, and the injection site is sterilized.

Direct intratumoral injection of the genetically engineered bacteria or virus of the invention into solid tumors may be advantageous as compared to intravenous administration. Using an intravenous injection method, only a small proportion of the bacteria may reach the target tumor. For example, following E. coli Nissle injection into the tail vein of 4T1 tumor-bearing mice, most bacteria (>99%) are quickly cleared from the animals and only a small percentage of the administered bacteria colonize the tumor (Stritzker et al., 2007). In particular, in large animals and human patients, which have relatively large blood volumes and relatively small tumors compared to mice, intratumoral injection may be especially beneficial. Injection directly into the tumor allows the delivery of a higher concentration of therapeutic agent and avoids the toxicity, which can result from systemic administration. In addition, intratumoral injection of bacteria induces robust and localized immune responses within the tumor.

Depending on the location, tumor type, and tumor size, different administration techniques may be used, including but not limited to, cutaneous, subcutaneous, and percutaneous injection, therapeutic endoscopic ultrasonography, or endobronchial intratumor delivery. Prior to the intratumor administration procedures, sedation in combination with a local anesthetic and standard cardiac, pressure, and oxygen monitoring, or full anesthesia of the patient is performed.

For some tumors, percutaneous injection can be employed, which is the least invasive administration method. Ultrasound, computed tomography (CT) or fluoroscopy can be used as guidance to introduce and position the needle. Percutaneous intratumoral injection is for example described for hepatocellular carcinoma in Lencioni et al., 2010. Intratumoral injection of cutaneous, subcutaneous, and nodal tumors is for example described in WO/2014/036412 (Amgen) for late stage melanoma.

Single insertion points or multiple insertion points can be used in percutaneous injection protocols. Using a single insertion point, the solution may be injected percutaneously along multiple tracks, as far as the radial reach of the needle allows. In other embodiments, multiple injection points may be used if the tumor is larger than the radial reach of the needle. The needle can be pulled back without exiting, and redirected as often as necessary until the full dose is injected and dispersed. To maintain sterility, a separate needle is used for each injection. Needle size and length varies depending on the tumor type and size.

In some embodiments, the tumor is injected percutaneously with an 18-gauge multipronged needle (Quadra-Fuse, Rex Medical). The device consists of an 18 gauge puncture needle 20 cm in length. The needle has three retractable prongs, each with four terminal side holes and a connector with extension tubing clamp. The prongs are deployed from the lateral wall of the needle. The needle can be introduced percutaneously into the center of the tumor and can be positioned at the deepest margin of the tumor. The prongs are deployed to the margins of the tumor. The prongs are deployed at maximum length and then are retracted at defined intervals. Optionally, one or more rotation-injection-rotation maneuvers can be performed, in which the prongs are retracted, the needle is rotated by a 60 degrees, which is followed by repeat deployment of the prongs and additional injection.

Therapeutic endoscopic ultrasonography (EUS) is employed to overcome the anatomical constraints inherent in gaining access to certain other tumors (Shirley et al., 2013). EUS-guided fine needle injection (EUS-FNI) has been successfully used for antitumor therapies for the treatment of head and neck, esophageal, pancreatic, hepatic, and adrenal masses (Verna et al, 2008). EUS-FNI has been extensively used for pancreatic cancer injections. Fine-needle injection requires the use of the curvilinear echoendoscope. The esophagus is carefully intubated and the echoendoscope is passed into the stomach and duodenum where the pancreatic examination occurs, and the target tumor is identified. The largest plane is measured to estimate the tumor volume and to calculate the injection volume. The appropriate volume is drawn into a syringe. A primed 22-gauge fine needle aspiration (FNA) needle is passed into the working channel of the echoendoscope. Under ultrasound guidance, the needle is passed into the tumor. Depending on the size of the tumor, administration can be performed by dividing the tumor into sections and then injecting the corresponding fractions of the volume into each section. Use of an installed endoscopic ultrasound processor with Doppler technology assures there are no arterial or venous structures that may interfere with the needle passage into the tumor (Shirley et al., 2013). In some embodiments, 'multiple injectable needle' (MIN) for EUS-FNI can be used to improvement the injection distribution to the tumor in comparison with straight-type needles (Ohara et al., 2013).

Intratumoral administration for lung cancer, such as non-small cell lung cancer, can be achieved through endobronchial intratumor delivery methods, as described in Celikoglu et al., 2008. Bronchoscopy (trans-nasal or oral) is conducted to visualize the lesion to be treated. The tumor volume can be estimated visually from visible length-width height measurements over the bronchial surface. The needle device is then introduced through the working channel of the bronchoscope. The needle catheter, which consists of a metallic needle attached to a plastic catheter, is placed within a sheath to prevent damage by the needle to the working channel during advancement. The needle size and length varies and is determined according to tumor type and size of the tumor. Needles made from plastic are less rigid than metal needles and are ideal, since they can be passed around sharper bends in the working channel. The needle is inserted into the lesion and the genetically engineered bacteria of the invention are in injected. Needles are inserted repeatedly at several insertion points until the tumor mass is completely perfused. After each injection, the needle is withdrawn entirely from the tumor and is then embedded at another location. At the end of the bronchoscopic injection session, removal of any necrotic debris caused by the treatment may be removed using mechanical dissection, or other ablation techniques accompanied by irrigation and aspiration.

In some embodiments, the genetically engineered bacteria or virus capable of delivering an immune modulator to a target tumor are administrated directly into the tumor using methods, including but not limited to, percutaneous injection, EUS-FNI, or endobronchial intratumor delivery methods. In some cases, other techniques, such as laparoscopic or open surgical techniques are used to access the target tumor, however, these techniques are much more invasive and bring with them much greater morbidity and longer hospital stays.

In some embodiments, bacteria, e.g., *E. coli* Nissle, or spores, e.g., *Clostridium novyi* NT, are dissolved in sterile phosphate buffered saline (PBS) for systemic or intratumor injection.

The dose to be injected is derived from the type and size of the tumor. The dose of a drug or the genetically engineered bacteria or virus of the invention is typically lower, e.g., orders of magnitude lower, than a dose for systemic intravenous administration.

The volume injected into each lesion is based on the size of the tumor. To obtain the tumor volume, a measurement of the largest plane can be conducted. The estimated tumor volume can then inform the determination of the injection volume as a percentage of the total volume. For example, an injection volume of approximately 20-40% of the total tumor volume can be used.

For example, as is for example described in WO/2014/036412 (Amgen), for tumors larger than 5 cm in their largest dimension, up to 4 ml can be injected. For tumors between 2.5 and 5 cm in their largest dimension, up to 2 ml can be injected. For tumors between 2.5 and 5 cm in their largest dimension, up to 2 ml can be injected. For tumors between 1.5 and 2.5 cm in their largest dimension, up to 1 ml can be injected. For tumors between 0.5 and 1.5 cm in their largest dimension, up to 0.5 ml can be injected. For tumors equal or small than 0.5 in their largest dimension, up to 0.1 ml can be injected. Alternatively, ultrasound scan can be used to determine the injection volume that can be taken up by the tumor without leakage into surrounding tissue.

In some embodiments, the treatment regimen will include one or more intratumoral administrations. In some embodiments, a treatment regimen will include an initial dose, which followed by at least one subsequent dose. One or more doses can be administered sequentially in two or more cycles.

For example, a first dose may be administered at day 1, and a second dose may be administered after 1, 2, 3, 4, 5, 6, days or 1, 2, 3, or 4 weeks or after a longer interval. Additional doses may be administered after 1, 2, 3, 4, 5, 6, days or after 1, 2, 3, or 4 weeks or longer intervals. In some embodiments, the first and subsequent administrations have the same dosage. In other embodiments, different doses are administered. In some embodiments, more than one dose is administered per day, for example, two, three or more doses can be administered per day.

The routes of administration and dosages described are intended only as a guide. The optimum route of administration and dosage can be readily determined by a skilled practitioner. The dosage may be determined according to various parameters, especially according to the location of the tumor, the size of the tumor, the age, weight and condition of the patient to be treated and the route and method of administration.

In one embodiment, *Clostridium* spores are delivered systemically. In another embodiment, *Clostridium* spores are delivered via intratumor injection. In one embodiment, *E. coli* Nissle are delivered via intratumor injection In other embodiments, *E coli* Nissle, which is known to hone to tumors, is administered via intravenous injection or orally, as described in a mouse model in for example in Danino et al. 2015, or Stritzker et al., 2007, the contents of which is herein incorporated by reference in its entirety. *E. coli* Nissle mutations to reduce toxicity include but are not limited to msbB mutants resulting in non-myristoylated LPS and reduced endotoxin activity, as described in Stritzker et al., 2010 (Stritzker et al, Bioengineered Bugs 1:2, 139-145; Myristylation negative msbB-mutants of probiotic *E. coli* Nissle 1917 retain tumor specific colonization properties but show less side effects in immunocompetent mice.

For intravenous injection a preferred dose of bacteria is the dose in which the greatest number of bacteria is found in the tumor and the lowest amount found in other tissues. In mice, Stritzker et al (International Journal of Medical Microbiology 297 (2007) 151-162; Tumor specific colonization, tissue distribution, and gene induction by *Escherichia coli* Nissle 1917 in live mice) found that the lowest number of bacteria needed for successful tumor colonization was $2 \times 10^4$ CFU, in which half of the mice showed tumor colonization. Injection of $2 \times 10^5$ and $2 \times 10^6$ CFU resulted in colonization of all tumors, and numbers of bacteria in the tumors increased. However, at higher concentrations, bacterial counts became detectable in the liver and the spleen.

In some embodiments, the genetically engineered microorganisms of the invention may be administered orally. In some embodiments, the genetically engineered bacteria may be useful in the prevention, treatment or management of liver cancer or liver metastases. For example, Danino et al showed that orally administered *E. coli* Nissle is able to colonize liver metastases by crossing the gastrointestinal tract in a mouse model of liver metastases (Danino et al., Programmable probiotics for detection of cancer in urine. Science Translational Medicine, 7 (289): 1-10, the contents of which is herein incorporated by reference in its entirety).

In one embodiment, the genetically engineered microorganismmicroorganism is delivered by intratumor injection. In one embodiment, the genetically engineered microorganismmicroorganisms is delivered intrapleurally. In one embodiment, the genetically engineered microorganism is delivered subcutaneously. In one embodiment, the genetically engineered microorganism is delivered intravenously. In one embodiment, the genetically engineered microorganism is delivered intrapleurally.

Tumor types into which the engineered bacteria or virus of the current invention are intratumorally delivered include locally advanced and metastatic tumors, including but not limited to, B, T, and NK cell lymphomas, colon and rectal cancers, melanoma, including metastatic melanoma, mycosis fungoides, Merkel carcinoma, liver cancer, including hepatocellular carcinoma and liver metastasis secondary to colorectal cancer, pancreatic cancer, breast cancer, follicular lymphoma, prostate cancer, refractory liver cancer, and Merkel cell carcinoma.

The genetically engineered microorganisms disclosed herein may be administered topically and formulated in the form of an ointment, cream, transdermal patch, lotion, gel, shampoo, spray, aerosol, solution, emulsion, or other form well known to one of skill in the art. See, e.g., "Remington's Pharmaceutical Sciences," Mack Publishing Co., Easton, Pa. In an embodiment, for non-sprayable topical dosage forms, viscous to semi-solid or solid forms comprising a carrier or one or more excipients compatible with topical application and having a dynamic viscosity greater than water are employed. Suitable formulations include, but are not limited to, solutions, suspensions, emulsions, creams, ointments, powders, liniments, salves, etc., which may be sterilized or mixed with auxiliary agents (e.g., preservatives, stabilizers, wetting agents, buffers, or salts) for influencing various properties, e.g., osmotic pressure. Other suitable topical dosage forms include sprayable aerosol preparations wherein the active ingredient in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms. Examples of such additional ingredients are well known in the art. In one embodiment, the pharmaceutical composition comprising the recombinant bacteria of the invention may be formulated as a hygiene product. For example, the hygiene product may be an antibacterial formulation, or a fermentation product such as a fermentation broth. Hygiene products may be, for example, shampoos, conditioners, creams, pastes, lotions, and lip balms.

The genetically engineered microorganisms disclosed herein may be administered orally and formulated as tablets, pills, dragees, capsules, liquids, gels, syrups, slurries, suspensions, etc. Pharmacological compositions for oral use can be made using a solid excipient, optionally grinding the resulting mixture, and processing the mixture of granules, after adding suitable auxiliaries if desired, to obtain tablets or dragee cores. Suitable excipients include, but are not limited to, fillers such as sugars, including lactose, sucrose, mannitol, or sorbitol; cellulose compositions such as maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP) or polyethylene glycol (PEG). Disintegrating agents may also be added, such as cross-linked polyvinylpyrrolidone, agar, alginic acid or a salt thereof such as sodium alginate.

Tablets or capsules can be prepared by conventional means with pharmaceutically acceptable excipients such as binding agents (e.g., pregelatinized maize starch, polyvinylpyrrolidone, hydroxypropyl methylcellulose, carboxymethylcellulose, polyethylene glycol, sucrose, glucose, sorbitol, starch, gum, kaolin, and tragacanth); fillers (e.g., lactose, microcrystalline cellulose, or calcium hydrogen phosphate); lubricants (e.g., calcium, aluminum, zinc, stearic acid, polyethylene glycol, sodium lauryl sulfate, starch, sodium benzoate, L-leucine, magnesium stearate, talc, or silica); disintegrants (e.g., starch, potato starch, sodium starch glycolate, sugars, cellulose derivatives, silica powders); or wetting agents (e.g., sodium lauryl sulphate). The tablets may be coated by methods well known in the art. A coating shell may be present, and common membranes include, but are not limited to, polylactide, polyglycolic acid, polyanhydride, other biodegradable polymers, alginate-polylysine-alginate (APA), alginate-polymethylene-co-guanidine-alginate (A-PMCG-A), hydroymethylacrylate-methyl methacrylate (HEMA-MMA), multilayered HEMA-MMA-MAA, polyacrylonitrilevinylchloride (PAN-PVC), acrylonitrile/sodium methallylsulfonate (AN-69), polyethylene glycol/poly pentamethylcyclopentasiloxane/polydimethylsiloxane (PEG/PD5/PDMS), poly N,N-dimethyl acrylamide (PDMAAm), siliceous encapsulates, cellulose sulphate/sodium alginate/polymethylene-co-guanidine (CS/A/PMCG), cellulose acetate phthalate, calcium alginate, k-carrageenan-locust bean gum gel beads, gellan-xanthan beads, poly(lactide-co-glycolides), carrageenan, starch poly-anhydrides, starch polymethacrylates, polyamino acids, and enteric coating polymers.

In some embodiments, the genetically engineered bacteria are enterically coated for release into the gut or a particular region of the gut, for example, the large intestine. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

In some embodiments, enteric coating materials may be used, in one or more coating layers (e.g., outer, inner and/o intermediate coating layers). Enteric coated polymers remain unionized at low pH, and therefore remain insoluble. But as the pH increases in the gastrointestinal tract, the acidic functional groups are capable of ionization, and the polymer swells or becomes soluble in the intestinal fluid.

Materials used for enteric coatings include Cellulose acetate phthalate (CAP), Poly(methacrylic acid-co-methyl methacrylate), Cellulose acetate trimellitate (CAT), Poly (vinyl acetate phthalate) (PVAP) and Hydroxypropyl methylcellulose phthalate (HPMCP), fatty acids, waxes, Shellac (esters of aleurtic acid), plastics and plant fibers. Additionally, Zein, Aqua-Zein (an aqueous zein formulation containing no alcohol), amylose starch and starch derivatives, and dextrins (e.g., maltodextrin) are also used. Other known enteric coatings include ethylcellulose, methylcellulose, hydroxypropyl methylcellulose, amylose acetate phthalate, cellulose acetate phthalate, hydroxyl propyl methyl cellulose phthalate, an ethylacrylate, and a methylmethacrylate.

Coating polymers also may comprise one or more of, phthalate derivatives, CAT, HPMCAS, polyacrylic acid derivatives, copolymers comprising acrylic acid and at least one acrylic acid ester, Eudragit™ S (poly(methacrylic acid, methyl methacrylate)1:2); Eudragit L100TM S (poly(methacrylic acid, methyl methacrylate)1:1); Eudragit L30D™, (poly(methacrylic acid, ethyl acrylate)1:1); and (Eudragit L100-55) (poly(methacrylic acid, ethyl acrylate)1:1) (Eudragit™ L is an anionic polymer synthesized from methacrylic acid and methacrylic acid methyl ester), polymethyl methacrylate blended with acrylic acid and acrylic ester copolymers, alginic acid, ammonia alginate, sodium, potassium, magnesium or calcium alginate, vinyl acetate copolymers, polyvinyl acetate 30D (30% dispersion in water), a neutral methacrylic ester comprising poly(dimethylaminoethylacrylate) ("Eudragit E™), a copolymer of methylmethacrylate and ethylacrylate with trimethylammonioethyl methacrylate chloride, a copolymer of methylmethacrylate and ethylacrylate, Zein, shellac, gums, or polysaccharides, or a combination thereof.

Coating layers may also include polymers which contain Hydroxypropylmethylcellulose (HPMC), Hydroxypropylethylcellulose (HPEC), Hydroxypropylcellulose (HPC), hydroxypropylethylcellulose (HPEC), hydroxymethylpropylcellulose (HMPC), ethylhydroxyethylcellulose (EHEC) (Ethulose), hydroxyethylmethylcellulose (HEMC), hydroxymethylethylcellulose (HMEC), propylhydroxyethylcellulose (PHEC), methylhydroxyethylcellulose (M H EC), hydrophobically modified hydroxyethylcellulose (NEXTON), carboxymethyl hydroxyethylcellulose (CMHEC), Methylcellulose, Ethylcellulose, water soluble vinyl acetate copolymers, gums, polysaccharides such as alginic acid and alginates such as ammonia alginate, sodium alginate, potassium alginate, acid phthalate of carbohydrates, amylose acetate phthalate, cellulose acetate phthalate (CAP), cellulose ester phthalates, cellulose ether phthalates, hydroxypropylcellulose phthalate (HPCP), hydroxypropylethylcellulose phthalate (HPECP), hydroxyproplymethylcellulose phthalate (HPMCP), hydroxyproplymethylcellulose acetate succinate (HPMCAS).

In some embodiments, the genetically engineered microorganisms are enterically coated for release into the gut or a particular region of the gut, for example, the large intestine.

The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

Liquid preparations for oral administration may take the form of solutions, syrups, suspensions, or a dry product for constitution with water or other suitable vehicle before use. Such liquid preparations may be prepared by conventional means with pharmaceutically acceptable agents such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of the genetically engineered microorganisms described herein.

In one embodiment, the genetically engineered microorganisms of the disclosure may be formulated in a composition suitable for administration to pediatric subjects. As is well known in the art, children differ from adults in many aspects, including different rates of gastric emptying, pH, gastrointestinal permeability, etc. (Ivanovska et al., *Pediatrics*, 134(2):361-372, 2014). Moreover, pediatric formulation acceptability and preferences, such as route of administration and taste attributes, are critical for achieving acceptable pediatric compliance. Thus, in one embodiment, the composition suitable for administration to pediatric subjects may include easy-to-swallow or dissolvable dosage forms, or more palatable compositions, such as compositions with added flavors, sweeteners, or taste blockers. In one embodiment, a composition suitable for administration to pediatric subjects may also be suitable for administration to adults.

In one embodiment, the composition suitable for administration to pediatric subjects may include a solution, syrup, suspension, elixir, powder for reconstitution as suspension or solution, dispersible/effervescent tablet, chewable tablet, gummy candy, lollipop, freezer pop, troche, chewing gum, oral thin strip, orally disintegrating tablet, sachet, soft gelatin capsule, sprinkle oral powder, or granules. In one embodiment, the composition is a gummy candy, which is made from a gelatin base, giving the candy elasticity, desired chewy consistency, and longer shelf-life. In some embodiments, the gummy candy may also comprise sweeteners or flavors.

In one embodiment, the composition suitable for administration to pediatric subjects may include a flavor. As used herein, "flavor" is a substance (liquid or solid) that provides a distinct taste and aroma to the formulation. Flavors also help to improve the palatability of the formulation. Flavors include, but are not limited to, strawberry, vanilla, lemon, grape, bubble gum, and cherry.

In certain embodiments, the genetically engineered microorganisms may be orally administered, for example, with an inert diluent or an assimilable edible carrier. The compound may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

In another embodiment, the pharmaceutical composition comprising the recombinant bacteria of the invention may be a comestible product, for example, a food product. In one embodiment, the food product is milk, concentrated milk, fermented milk (yogurt, sour milk, frozen yogurt, lactic acid bacteria-fermented beverages), milk powder, ice cream, cream cheeses, dry cheeses, soybean milk, fermented soybean milk, vegetable-fruit juices, fruit juices, sports drinks, confectionery, candies, infant foods (such as infant cakes), nutritional food products, animal feeds, or dietary supplements. In one embodiment, the food product is a fermented food, such as a fermented dairy product. In one embodiment, the fermented dairy product is yogurt. In another embodiment, the fermented dairy product is cheese, milk, cream, ice cream, milk shake, or kefir. In another embodiment, the recombinant bacteria of the invention are combined in a preparation containing other live bacterial cells intended to serve as probiotics. In another embodiment, the food product is a beverage. In one embodiment, the beverage is a fruit juice-based beverage or a beverage containing plant or herbal extracts. In another embodiment, the food product is a jelly or a pudding. Other food products suitable for administration of the recombinant bacteria of the invention are well known in the art. For example, see U.S. 2015/0359894 and US 2015/0238545, the entire contents of each of which are expressly incorporated herein by reference. In yet another embodiment, the pharmaceutical composition of the invention is injected into, sprayed onto, or sprinkled onto a food product, such as bread, yogurt, or cheese.

In some embodiments, the composition is formulated for intraintestinal administration, intrajejunal administration, intraduodenal administration, intraileal administration, gastric shunt administration, or intracolic administration, via nanoparticles, nanocapsules, microcapsules, or microtablets, which are enterically coated or uncoated. The pharmaceutical compositions may also be formulated in rectal compositions such as suppositories or retention enemas, using, e.g., conventional suppository bases such as cocoa butter or other glycerides. The compositions may be suspensions, solutions, or emulsions in oily or aqueous vehicles, and may contain suspending, stabilizing and/or dispersing agents.

The genetically engineered microorganisms described herein may be administered intranasally, formulated in an aerosol form, spray, mist, or in the form of drops, and conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). Pressurized aerosol dosage units may be determined by providing a valve to deliver a metered amount. Capsules and cartridges (e.g., of gelatin) for use in an inhaler or insufflator may be formulated containing a powder mix of the compound and a suitable powder base such as lactose or starch.

The genetically engineered microorganisms may be administered and formulated as depot preparations. Such long acting formulations may be administered by implantation or by injection, including intravenous injection, subcutaneous injection, local injection, direct injection, or infusion. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, disclosed herein are pharmaceutically acceptable compositions in single dosage forms. Single dosage forms may be in a liquid or a solid form. Single dosage forms may be administered directly to a patient without modification or may be diluted or reconstituted prior to administration. In certain embodiments, a single dosage form may be administered in bolus form, e.g., single injection, single oral dose, including an oral dose that comprises multiple tablets, capsule, pills, etc. In alternate embodiments, a single dosage form may be administered over a period of time, e.g., by infusion.

Single dosage forms of the pharmaceutical composition may be prepared by portioning the pharmaceutical composition into smaller aliquots, single dose containers, single dose liquid forms, or single dose solid forms, such as tablets, granulates, nanoparticles, nanocapsules, microcapsules, microtablets, pellets, or powders, which may be enterically coated or uncoated. A single dose in a solid form may be reconstituted by adding liquid, typically sterile water or saline solution, prior to administration to a patient.

In other embodiments, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

Dosage regimens may be adjusted to provide a therapeutic response. Dosing can depend on several factors, including severity and responsiveness of the disease, route of administration, time course of treatment (days to months to years), and time to amelioration of the disease. For example, a single bolus may be administered at one time, several divided doses may be administered over a predetermined period of time, or the dose may be reduced or increased as indicated by the therapeutic situation. The specification for the dosage is dictated by the unique characteristics of the active compound and the particular therapeutic effect to be achieved. Dosage values may vary with the type and severity of the condition to be alleviated. For any particular subject, specific dosage regimens may be adjusted over time according to the individual need and the professional judgment of the treating clinician. Toxicity and therapeutic efficacy of compounds provided herein can be determined by standard pharmaceutical procedures in cell culture or animal models. For example, $LD_{50}$, $ED_{50}$, $EC_{50}$, and $IC_{50}$ may be determined, and the dose ratio between toxic and therapeutic effects ($LD_{50}/ED_{50}$) may be calculated as the therapeutic index. Compositions that exhibit toxic side effects may be used, with careful modifications to minimize potential damage to reduce side effects. Dosing may be estimated initially from cell culture assays and animal models. The data obtained from in vitro and in vivo assays and animal studies can be used in formulating a range of dosage for use in humans.

The ingredients are supplied either separately or mixed together in unit dosage form, for example, as a dry lyophilized powder or water-free concentrate in a hermetically sealed container such as an ampoule or sachet indicating the quantity of active agent. If the mode of administration is by injection, an ampoule of sterile water for injection or saline can be provided so that the ingredients may be mixed prior to administration.

The pharmaceutical compositions may be packaged in a hermetically sealed container such as an ampoule or sachet indicating the quantity of the agent. In one embodiment, one or more of the pharmaceutical compositions is supplied as a dry sterilized lyophilized powder or water-free concentrate in a hermetically sealed container and can be reconstituted (e.g., with water or saline) to the appropriate concentration for administration to a subject. In an embodiment, one or more of the prophylactic or therapeutic agents or pharmaceutical compositions is supplied as a dry sterile lyophilized powder in a hermetically sealed container stored between 2° C. and 8° C. and administered within 1 hour, within 3 hours, within 5 hours, within 6 hours, within 12 hours, within 24 hours, within 48 hours, within 72 hours, or within one week after being reconstituted. Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition may be prepared as an injectable solution and can further comprise an agent useful as an adjuvant, such as those used to increase absorption or dispersion, e.g., hyaluronidase.

In some embodiments, the genetically engineered microorganisms and composition thereof is formulated for intravenous administration, intratumor administration, or peritumor administration. The genetically engineered microorganisms may be formulated as depot preparations. Such long acting formulations may be administered by implantation or by injection. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, the genetically engineered OVs are prepared for delivery, taking into consideration the need for efficient delivery and for overcoming the host antiviral immune response. Approaches to evade antiviral response include the administration of different viral serotypes as part of the treatment regimen (serotype switching), formulation, such as polymer coating to mask the virus from antibody recognition and the use of cells as delivery vehicles.

In another embodiment, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

The genetically engineered bacteria of the invention may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Methods of Treatment

Another aspect of the invention provides methods of treating cancer. In some embodiments, the invention provides methods for reducing, ameliorating, or eliminating one or more symptom(s) associated with cancer. In some embodiments, the cancer is selected from adrenal cancer, adrenocortical carcinoma, anal cancer, appendix cancer, bile duct cancer, bladder cancer, bone cancer (e.g., Ewing sarcoma tumors, osteosarcoma, malignant fibrous histiocytoma), brain cancer (e.g., astrocytomas, brain stem glioma, craniopharyngioma, ependymoma), bronchial tumors, central nervous system tumors, breast cancer, Castleman disease, cervical cancer, colon cancer, rectal cancer, colorectal cancer, endometrial cancer, esophageal cancer, eye cancer, gallbladder cancer, gastrointestinal cancer, gastrointestinal carcinoid tumors, gastrointestinal stromal tumors, gestational trophoblastic disease, heart cancer, Kaposi sarcoma, kidney cancer, laryngeal cancer, hypopharyngeal cancer, leukemia (e.g., acute lymphoblastic leukemia, acute myeloid leukemia, chronic lymphocytic leukemia, chronic myelogenous leukemia), liver cancer, lung cancer, lymphoma (e.g., AIDS-related lymphoma, Burkitt lymphoma, cutaneous T cell lymphoma, Hogkin lymphoma, Non-Hogkin lymphoma, primary central nervous system lymphoma), malignant mesothelioma, multiple myeloma, myelodysplastic syndrome, nasal cavity cancer, paranasal sinus cancer, nasopharyngeal cancer, neuroblastoma, oral cavity cancer, oropharyngeal cancer, osteosarcoma, ovarian cancer, pancreatic cancer, penile cancer, pituitary tumors, prostate cancer, retinoblastoma, rhabdomyosarcoma, rhabdoid tumor, salivary gland cancer, sarcoma, skin cancer (e.g., basal cell carcinoma, melanoma), small intestine cancer, stomach cancer, teratoid tumor, testicular cancer, throat cancer, thymus cancer, thyroid cancer, unusual childhood cancers, urethral cancer, uterine cancer, uterine sarcoma, vaginal cancer, vulvar cancer, Waldenström macroglobulinemia, and Wilms tumor. In some embodiments, the symptom(s) associated thereof include, but are not limited to, anemia, loss of appetite, irritation of bladder lining, bleeding and bruising (thrombocytopenia), changes in taste or smell, constipation, diarrhea, dry mouth, dysphagia, edema, fatigue, hair loss (alopecia), infection, infertility, lymphedema, mouth sores, nausea, pain, peripheral neuropathy, tooth decay, urinary tract infections, and/or problems with memory and concentration.

The method may comprise preparing a pharmaceutical composition with at least one genetically engineered species, strain, or subtype of bacteria described herein, and administering the pharmaceutical composition to a subject in a therapeutically effective amount. The genetically engineered microorganisms may be administered locally, e.g., intratumorally or peritumorally into a tissue or supplying vessel, or systemically, e.g., intravenously by infusion or injection. In some embodiments, the genetically engineered bacteria are administered intravenously, intratumorally, intra-arterially, intramuscularly, intraperitoneally, orally, or topically. In some embodiments, the genetically engineered microorganisms are administered intravenously, i.e., systemically.

In certain embodiments, administering the pharmaceutical composition to the subject reduces cell proliferation, tumor growth, and/or tumor volume in a subject. In some embodiments, the methods of the present disclosure may reduce cell proliferation, tumor growth, and/or tumor volume by at least about 10%, 20%, 25%, 30%, 40%, 50%, 60%, 70%, 75%, 80%, 85%, 90%, 95%, or more as compared to levels in an untreated or control subject. In some embodiments, reduction is measured by comparing cell proliferation, tumor growth, and/or tumor volume in a subject before and after administration of the pharmaceutical composition. In some embodiments, the method of treating or ameliorating a cancer in a subject allows one or more symptoms of the cancer to improve by at least about 10%, 20%, 30%, 40%, 50%, 60%, 70%, 80%, 90%, 95%, or more.

Before, during, and after the administration of the pharmaceutical composition, cancerous cells and/or biomarkers in a subject may be measured in a biological sample, such as blood, serum, plasma, urine, peritoneal fluid, and/or a biopsy from a tissue or organ. In some embodiments, the methods may include administration of the compositions of the invention to reduce tumor volume in a subject to an undetectable size, or to less than about 1%, 2%, 5%, 10%, 20%, 25%, 30%, 40%, 50%, 60%, 70%, 75%, 80%, or 90% of the subject's tumor volume prior to treatment. In other embodiments, the methods may include administration of the compositions of the invention to reduce the cell proliferation rate or tumor growth rate in a subject to an undetectable rate, or to less than about 1%, 2%, 5%, 10%, 20%, 25%, 30%, 40%, 50%, 60%, 70%, 75%, 80%, or 90% of the rate prior to treatment.

For genetically engineered microorganisms expressing immune-based anti-cancer molecules, responses patterns may be different than for traditional cytotoxic therapies. For example, tumors treated with immune-based therapies may enlarge before they regress, and/or new lesions may appear (Agarwala et al., 2015). Increased tumor size may be due to heavy infiltration with lymphocytes and macrophages that are normally not present in tumor tissue. Additionally, response times may be slower than response times associated with standard therapies, e.g., cytotoxic therapies. In some embodiments, delivery of the anti-cancer molecule may modulate the growth of a subject's tumor and/or ameliorate the symptoms of a cancer while temporarily increasing the volume and/or size of the tumor.

The genetically engineered bacteria may be destroyed, e.g., by defense factors in tissues or blood serum (Sonnenborn et al., 2009), or by activation of a kill switch, several hours or days after administration. Thus, the pharmaceutical composition comprising the gene or gene cassette for producing the anti-cancer molecule may be re-administered at a therapeutically effective dose and frequency. In alternate embodiments, the genetically engineered bacteria are not destroyed within hours or days after administration and may propagate in the tumor and colonize the tumor.

The pharmaceutical composition may be administered alone or in combination with one or more additional therapeutic agents, e.g., a chemotherapeutic drug or a checkpoint inhibitor, e.g., as described herein and known in the art. An important consideration in selecting the one or more additional therapeutic agents is that the agent(s) should be compatible with the genetically engineered bacteria of the invention, e.g., the agent(s) must not kill the bacteria. In some studies, the efficacy of anticancer immunotherapy, e.g., CTLA-4 or PD-1 inhibitors, requires the presence of particular bacterial strains in the microbiome (Ilda et al., 2013; Vétizou et al., 2015; Sivan et al., 2015). In some embodiments, the pharmaceutical composition comprising the bacteria augments the effect of a checkpoint inhibitor or a chemotherapeutic agent, e.g., allowing lowering of a the dose of systemically administrated chemotherapeutic or immunotherapeutic agents. In some embodiments, the pharmaceutical composition is administered with one or more commensal or probiotic bacteria, e.g., *Bifidobacterium* or *Bacteroides*.

In some embodiments, the genetically engineered bacteria are administered sequentially, simultaneously, or subsequently to dosing with one or more chemotherapeutic agents selected from Trabectedin®, Belotecan®, Cisplatin®, Carboplatin®, Bevacizumab®, Pazopanib®, 5-Fluorouracil, Capecitabine®, Irinotecan®, and Oxaliplatin®. In some embodiments, the genetically engineered bacteria are administered sequentially, simultaneously, or subsequently to dosing with gemcitabine (Gemzar). In some embodiments, the genetically engineered bacteria are administered sequentially, simultaneously, or subsequently to dosing with cyclophosphamide. In any of these embodiments, the one or more bacteria are administered systemically or orally or intratumorally.

In some embodiments, one or more engineered bacteria described herein, which comprise gene sequence(s) encoding enzymes for the production or consumption of a metabolite, e.g., kynurenine or adenosine consumers or arginine producers, are administered sequentially, simultaneously, or subsequently to dosing with one or more chemotherapeutic agents. In some embodiments, the chemotherapeutic agent is administered systemically, and the bacteria are administered intratumorally. In some embodiments, the chemotherapeutic agent and bacteria are administered systemically. In some embodiments, one or more engineered bacteria described herein, which comprise gene sequence(s) encoding a metabolic converter, e.g., kynurenine or adenosine consumers or arginine producers, are administered sequentially, simultaneously, or subsequently to dosing with a chemotherapeutic agent. In one embodiment, the chemotherapeutic agent is cyclophosphamide.

In some embodiments, genetically engineered bacteria expressing any one or more of the described circuits for the degradation of adenosine are administered sequentially, simultaneously, or subsequently to dosing a chemotherapeutic agent. In one embodiment, the chemotherapeutic agent is cyclophosphamide. In some embodiments, genetically engineered bacteria expressing any one or more of the described circuits for the consumption of kynurenine are administered sequentially, simultaneously, or subsequently to dosing with a chemotherapeutic agent. In one embodiment, the chemotherapeutic agent is cyclophosphamide.

In some embodiments, genetically engineered bacteria expressing any one or more of the described circuits for the production of arginine are administered sequentially, simultaneously, or subsequently to dosing with a chemotherapeutic agent. In one embodiment, the chemotherapeutic agent is cyclophosphamide.

In some embodiments, the genetically engineered bacteria, e.g., adenosine consumer, kynurenine consumer, arginine producer, are able to improve anti-tumor activity (e.g., tumor proliferation, size, volume, weight) of the co-administered chemotherapeutic agent (e.g., cyclophosphamide or another agent described herein or known in the art), e.g., by 10%, 20%, 25%, 30%, 40%, 50%, 60%, 70%, 75%, 80%, 85%, 90%, 95%, or more as compared to a chemotherapy alone under the same conditions or as compared to an unmodified bacteria of the same subtype under the same conditions. In some embodiments, the genetically engineered bacteria, e.g., adenosine consumer, kynurenine consumer, arginine producer, are able to improve anti-tumor activity (e.g., tumor proliferation, size, volume, weight) of the co-administered chemotherapeutic agent (e.g., cyclophosphamide or another agent described herein or known in the art), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria, e.g., adenosine consumer, kynurenine consumer, arginine producer, are able to improve anti-tumor activity (e.g., tumor proliferation, size, volume, weight) of the co-administered chemotherapeutic agent (e.g., cyclophosphamide or another agent described herein or known in the art), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, one or more engineered bacteria described herein, which comprise gene sequence(s) for the production of an effector for immune activation and priming, are administered sequentially, simultaneously, or subsequently to dosing with a chemotherapeutic agent.

In some embodiments, the chemotherapeutic agent is administered systemically, and the bacteria are administered intratumorally. In some embodiments, the chemotherapeutic agent and bacteria are administered systemically. In some embodiments, one or more engineered bacteria described herein, which comprise gene sequence(s) encoding diadenylate cyclase or other STING agonist producing enzyme, are administered sequentially, simultaneously, or subsequently to dosing with a chemotherapeutic agent. In one embodiment, the chemotherapeutic agent is cyclophosphamide.

In some embodiments, the genetically engineered bacteria expressing diadenylate cyclase or other enzyme for the generation of STING agonist, are able to improve anti-tumor activity (e.g., tumor proliferation, size, volume, weight) of the co-administered chemotherapeutic agent (e.g., cyclophosphamide), e.g., by 10%, 20%, 25%, 30%, 40%, 50%, 60%, 70%, 75%, 80%, 85%, 90%, 95%, or more as compared to a chemotherapy alone under the same conditions or as compared to an unmodified bacteria of the same subtype under the same conditions. In some embodiments, the genetically engineered bacteria expressing diadenylate cyclase or other enzyme for the generation of STING agonist, are able to improve anti-tumor activity (e.g., tumor proliferation, size, volume, weight) of the co-administered chemotherapeutic agent (e.g., cyclophosphamide or another agent described herein or known in the art), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria expressing diadenylate cyclase or other enzyme for the generation of STING agonist, are able to improve anti-tumor activity (e.g., tumor proliferation, size, volume, weight) of the co-administered chemotherapeutic agent (e.g., cyclophosphamide or another agent described herein or known in the art), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, genetically engineered bacteria expressing any one or more of the described cytosine deaminases for the conversion of 5-FC to 5-FU are administered sequentially, simultaneously, or subsequently to dosing a chemotherapeutic agent. In one embodiment, the chemotherapeutic agent is cyclophosphamide.

In some embodiments, the genetically engineered bacteria expressing cytosine deaminase for the conversion of 5-FC to 5-FU, are able to improve anti-tumor activity (e.g., tumor proliferation, size, volume, weight) of the co-administered chemotherapeutic agent (e.g., cyclophosphamide), e.g., by 10%, 20%, 25%, 30%, 40%, 50%, 60%, 70%, 75%, 80%, 85%, 90%, 95%, or more as compared to a chemotherapy alone under the same conditions or as compared to an unmodified bacteria of the same subtype under the same conditions.

In some embodiments, the genetically engineered bacteria expressing cytosine deaminase for the conversion of 5-FC to 5-FU, are able to improve anti-tumor activity (e.g., tumor proliferation, size, volume, weight) of the co-administered chemotherapeutic agent (e.g., cyclophosphamide or another agent described herein or known in the art), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria expressing cytosine deaminase for the conversion of 5-FC to 5-FU, are able to improve anti-tumor activity (e.g., tumor proliferation, size, volume, weight) of the co-administered chemotherapeutic agent (e.g., cyclophosphamide or another agent described herein or known in the art), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, one or more genetically engineered bacteria comprising gene sequence(s) encoding one or more adenosine degradation enzyme(s) described herein are administered sequentially, simultaneously, or subsequently to dosing with one or more chemotherapeutic reagents described herein. In some embodiments, one or more engineered bacteria described herein which comprise gene sequence(s) encoding anti-CD40 antibody for production and secretion of anti-CD40 antibody into the extracellular environment, are administered sequentially, simultaneously, or subsequently to dosing with one or more chemotherapeutic reagents described herein. In another non-limiting example, one or more engineered bacteria described herein which comprise gene sequence(s) encoding anti-CD40 antibody for surface display, are administered sequentially, simultaneously, or subsequently to dosing with one or more chemotherapeutic reagents described herein. In another non-limiting example, one or more engineered bacteria described herein which comprise gene sequence(s) encoding hyaluronidase (for secretion or surface display), are administered sequentially, simultaneously, or subsequently to dosing with one or more chemotherapeutic reagents described herein.

In some embodiments, one or more engineered bacteria described herein which comprise gene sequence(s) encoding anti-CD40 antibody for secretion in combination with gene sequence(s) encoding enzymes for the degradation of adenosine, are administered sequentially, simultaneously, or subsequently to dosing with one or more chemotherapeutic reagents described herein. In some embodiments, one or more engineered bacteria described herein which comprise gene sequence(s) encoding hyaluronidase in combination with gene sequence(s) encoding enzymes for the degradation of adenosine, are administered sequentially, simultaneously, or subsequently to dosing with one or more chemotherapeutic reagents described herein. In some embodiments, the enzymes for adenosine consumption encoded by the genetically engineered bacteria comprise one or more of add, xapA, deoD, xdhA, xdhB, and xdhC and nupC. In some embodiments, the enzymes for adenosine consumption encoded by the genetically engineered bacteria comprise one or more of add, xapA, deoD, xdhA, xdhB, and xdhC and nupG. In any of these embodiments, the one or more bacteria are administered systemically or orally or intratumorally.

In some embodiments, one or more engineered bacteria described herein which comprise gene sequence(s) encoding anti-CD40 antibody for surface display or secretion in combination with gene sequence(s) encoding enzymes for the degradation of adenosine, are administered sequentially, simultaneously, or subsequently to dosing with one or more chemotherapeutic reagents described herein. In some embodiments, one or more engineered bacteria described herein which comprise gene sequence(s) encoding anti-CD40 antibody for surface display or secretion in combination with gene sequence(s) encoding hyaluronidase (for surface display or secretion), are administered sequentially, simultaneously, or subsequently to dosing with one or more chemotherapeutic reagents described herein.

In some embodiments, one or more engineered bacteria described herein which comprise gene sequence(s) encoding hyaluronidase(s) in combination with gene sequence(s) encoding enzymes for the degradation of adenosine and with gene sequence(s) encoding anti-CD40 antibody for surface display or secretion, are administered sequentially, simultaneously, or subsequently to dosing with one or more chemotherapeutic reagents described herein. In one embodiment, the genetically engineered bacteria comprising gene sequence(s) encoding one or more of adenosine degradation enzyme(s) or gene sequence(s) encoding hyaluronidase or gene sequence(s) encoding anti-CD40 antibody for surface display or secretion, alone or in combination with one or more chemotherapeutic reagents described herein, are administered for the treatment, management or prevention of pancreatic ductal adenocarcinoma. In one embodiment, the genetically engineered bacteria comprising gene sequence(s) encoding one or more adenosine degradation enzyme(s), gene sequence(s) encoding hyaluronidase and gene sequence(s) encoding anti-CD40 antibody for surface display or secretion, alone or in combination with one or more chemotherapeutic reagents described herein, are administered for the treatment, management or prevention of pancreatic ductal adenocarcinoma. In any of these embodiments, the one or more chemotherapeutic reagent is administered systemically or orally or intratumorally. In any of these embodiments, the one or more bacteria are administered systemically or orally or intratumorally.

In some embodiments, in which the genetically engineered bacteria are combined with a chemotherapeutic agent, the genetically engineered bacteria are able to improve anti-tumor activity (e.g., tumor proliferation, size, volume, weight) of the co-administered chemotherapeutic agent (e.g., cyclophosphamide), e.g., by 10%, 20%, 25%, 30%, 40%, 50%, 60%, 70%, 75%, 80%, 85%, 90%, 95%, or more as compared to a chemotherapy alone under the same conditions or as compared to an unmodified bacteria of the same subtype under the same conditions. In some embodiments, the genetically engineered bacteria are able to improve anti-tumor activity (e.g., tumor proliferation, size, volume, weight) of the co-administered chemotherapeutic agent (e.g., cyclophosphamide or another agent described herein or known in the art), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria are able to improve anti-tumor activity (e.g., tumor proliferation, size, volume, weight) of the co-administered chemotherapeutic agent (e.g., cyclophosphamide or another agent described herein or known in the art), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, one or more genetically engineered bacteria comprising gene sequence(s) encoding one or more adenosine degradation enzyme(s) described herein are administered sequentially, simultaneously, or subsequently to dosing with gemcitabine. In some embodiments, the enzymes for adenosine consumption encoded by the genetically engineered bacteria comprise one or more of add, xapA, deoD, xdhA, xdhB, and xdhC and nupC. In some embodiments, the enzymes for adenosine consumption encoded by the genetically engineered bacteria comprise one or more of add, xapA, deoD, xdhA, xdhB, and xdhC and nupG. In some embodiments, one or more engineered bacteria described herein which comprise gene sequence(s) encoding anti-CD40 antibody for surface display or secretion, are administered sequentially, simultaneously, or subsequently to dosing with gemcitabine. In some embodiments, one or more engineered bacteria described herein which comprise gene sequence(s) encoding hyaluronidase for secretion or for surface display, are administered sequentially, simultaneously, or subsequently to dosing with gemcitabine. In any of these embodiments, the one or more bacteria are administered systemically or orally or intratumorally.

In some embodiments, one or more engineered bacteria described herein which comprise gene sequence(s) encoding anti-CD40 antibody for surface display or secretion in combination with gene sequence(s) encoding enzymes for the degradation of adenosine, are administered sequentially, simultaneously, or subsequently to dosing with gemcitabine. In one embodiment, the genetically engineered bacteria comprising gene sequence(s) encoding adenosine degradation enzyme(s) and gene sequence(s) encoding anti-CD40 antibody for surface display or secretion, alone or in combination with gemcitabine, are administered for the treatment, management or prevention of pancreatic ductal adenocarcinoma.

In some embodiments, one or more engineered bacteria described herein which comprise gene sequence(s) encoding anti-CD40 antibody for surface display or secretion in combination with gene sequence(s) encoding hyaluronidase, are administered sequentially, simultaneously, or subsequently to dosing with gemcitabine. In one embodiment, the genetically engineered bacteria comprising gene sequence(s) encoding hyaluronidase and gene sequence(s) encoding anti-CD40 antibody for surface display or secretion, alone or in combination with gemcitabine are administered for the treatment, management or prevention of pancreatic ductal adenocarcinoma. In any of these embodiments, gemcitabine is administered systemically or orally or intratumorally. In any of these embodiments, the one or more bacteria are administered systemically or orally or intratumorally.

In some embodiments, one or more engineered bacteria described herein which comprise gene sequence(s) encoding hyaluronidase for surface display or secretion in combination with gene sequence(s) encoding enzymes for the degradation of adenosine, are administered sequentially, simultaneously, or subsequently to dosing with gemcitabine. In one embodiment, the genetically engineered bacteria comprising gene sequence(s) encoding adenosine degradation enzyme(s) and gene sequence(s) encoding hyaluronidase for surface display or secretion, alone or in combination with gemcitabine, are administered for the treatment, management or prevention of pancreatic ductal adenocarcinoma. In one embodiment, the genetically engineered bacteria comprising gene sequence(s) encoding adenosine degradation enzyme(s) and gene sequence(s) encoding hyaluronidase for surface display or secretion, alone or in combination with gemcitabine, are administered for the treatment, management or prevention of pancreatic ductal adenocarcinoma. In any of these embodiments, gemcitabine is administered systemically or orally or intratumorally. In any of these embodiments, the one or more bacteria are administered systemically or orally or intratumorally.

In some embodiments, one or more engineered bacteria described herein which comprise gene sequence(s) encoding hyaluronidase for surface display or secretion in combination with gene sequence(s) encoding enzymes for the degradation of adenosine and gene sequence(s) encoding anti-CD40 antibody for surface display or secretion, are administered sequentially, simultaneously, or subsequently to dosing with gemcitabine. In one embodiment, the genetically engineered bacteria comprising gene sequence(s) encoding adenosine degradation enzyme(s) or gene sequence(s) encoding hyaluronidase for surface display or secretion or gene sequence(s) encoding anti-CD40 antibody for surface display or secretion, alone or in combination with gemcitabine, are administered for the treatment, management or prevention of pancreatic ductal adenocarcinoma. In one embodiment, the genetically engineered bacteria comprising gene sequence(s) encoding adenosine degradation enzyme(s) and gene sequence(s) encoding hyaluronidase for surface display or secretion and gene sequence(s) encoding anti-CD40 antibody for surface display or secretion, alone or in combination with gemcitabine, are administered for the treatment, management or prevention of pancreatic ductal adenocarcinoma. In any of these embodiments, gemcitabine is administered systemically or orally or intratumorally. In any of these embodiments, the one or more bacteria are administered systemically or orally or intratumorally.

In some embodiments, in which the genetically engineered bacteria are combined with a gemcitabine, the genetically engineered bacteria are able to improve anti-tumor activity (e.g., tumor proliferation, size, volume, weight) of the co-administered chemotherapeutic agent (e.g., cyclophosphamide), e.g., by 10%, 20%, 25%, 30%, 40%, 50%, 60%, 70%, 75%, 80%, 85%, 90%, 95%, or more as compared to a chemotherapy alone under the same conditions or as compared to an unmodified bacteria of the same subtype under the same conditions. In some embodiments, the genetically engineered bacteria are able to improve anti-tumor activity (e.g., tumor proliferation, size, volume, weight) of the co-administered chemotherapeutic agent (e.g., cyclophosphamide or another agent described herein or known in the art), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria are able to improve anti-tumor activity (e.g., tumor proliferation, size, volume, weight) of the co-administered chemotherapeutic agent (e.g., cyclophosphamide or another agent described herein or known in the art), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, the one or more genetically engineered bacteria are administered sequentially, simultaneously, or subsequently to dosing with one or more checkpoint inhibitors or other antibodies known in the art or described herein. Non-limiting examples of immune checkpoint inhibitors include CTLA-4 antibodies (including but not limited to Ipilimumab and Tremelimumab (CP675206)), anti-4-1BB (CD137, TNFRSF9) antibodies (including but not limited to PF-05082566, and Urelumab), anti CD134 (OX40) antibodies, including but not limited to Anti-OX40 antibody (Providence Health and Services), anti-PD-1 antibodies (including but not limited to Nivolumab, Pidilizumab, Pembrolizumab (MK-3475/SCH900475, lambrolizumab, REGN2810, PD-1 (Agenus)), anti-PD-L1 antibodies (including but not limited to durvalumab (MEDI4736), avelumab (MSB0010718C), and atezolizumab (MPDL3280A, RG7446, RO5541267)), and anti-KIR antibodies (including but not limited to Lirilumab), LAG3 antibodies (including but not limited to BMS-986016), anti-CCR4 antibodies (including but not limited to Mogamulizumab), anti-CD27 antibodies (including but not limited to Varlilumab), anti-CXCR4 antibodies (including but not limited to Ulocuplumab). In some embodiments, the at least one bacterial cell is administered sequentially, simultaneously, or subsequently to dosing with an anti-phosphatidyl serine antibody (including but not limited to Bavituximab).

In some embodiments, the at least one bacterial cell is administered sequentially, simultaneously, or subsequently to dosing with one or more antibodies selected from TLR9 antibody (including, but not limited to, MGN1703 PD-1 antibody (including, but not limited to, SHR-1210 (Incyte/Jiangsu Hengrui)), anti-OX40 antibody (including, but not limited to, OX40 (Agenus)), anti-Tim3 antibody (including, but not limited to, Anti-Tim3 (Agenus/INcyte)), anti-Lag3 antibody (including, but not limited to, Anti-Lag3 (Agenus/INcyte)), anti-B7H3 antibody (including, but not limited to, Enoblituzumab (MGA-271), anti-CT-011 (hBAT, hBAT1) as described in WO2009101611, anti-PDL-2 antibody (including, but not limited to, AMP-224 (described in WO2010027827 and WO2011066342)), anti-CD40 antibody (including, but not limited to, CP-870, 893), anti-CD40 antibody (including, but not limited to, CP-870, 893).

In some embodiments, one or more engineered bacteria described herein, which comprise gene sequence(s) encoding enzymes for the production or consumption of metabolite, e.g., kynurenine or adenosine consumers or arginine producers, are administered sequentially, simultaneously, or subsequently to dosing with one or more checkpoint inhibitors. In some embodiments, the checkpoint inhibitor is administered systemically, and the bacteria are administered intratumorally. In some embodiments, the checkpoint inhibitor and bacteria are administered systemically. In some embodiments, one or more engineered bacteria described herein, which comprise gene sequence(s) encoding a metabolic converter, e.g., kynurenine or adenosine consumers or arginine producers, are administered sequentially, simultaneously, or subsequently to dosing with an anti-PD1 antibody. In some embodiments, one or more engineered bacteria described herein, which comprise gene sequence(s) encoding a metabolic converter, e.g., kynurenine or adenosine consumers or arginine producers, are administered sequentially, simultaneously, or subsequently to dosing with an anti-CTLA-4 antibody.

In some embodiments, genetically engineered bacteria comprising gene sequence(s) encoding a metabolic converter, e.g., kynurenine or adenosine consumers or arginine producers, are administered sequentially, simultaneously, or subsequently to dosing with an anti-CTLA4 antibody and an anti-PD-1 antibody. In some embodiments, genetically engineered bacteria expressing any one or more of the described circuits for the degradation of adenosine are administered sequentially, simultaneously, or subsequently to dosing with an anti-CTLA4 antibody.

In some embodiments, genetically engineered bacteria expressing any one or more of the described circuits for the degradation of adenosine are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, genetically engineered bacteria expressing any one or more of the described circuits for the degradation of adenosine are administered sequentially, simultaneously, or subsequently to dosing with anti-PD1 antibody. In some embodiments, genetically engineered bacteria expressing any one or more of the described circuits for the degradation of adenosine are administered sequentially, simultaneously, or subsequently to dosing with anti-CTLA4 antibody. In some embodiments, genetically engineered bacteria of expressing any one or more of the described circuits for the degradation of adenosine are administered sequentially, simultaneously, or subsequently to dosing with an anti-CTLA4 antibody and anti-PD1 antibody. In some embodiments, genetically engineered bacteria expressing any one or more of the described circuits for the consumption of kynurenine are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, genetically engineered bacteria expressing any one or more of the described circuits for the consumption of kynurenine are administered sequentially, simultaneously, or subsequently to dosing with an anti-CTLA4 antibody. In some embodiments, genetically engineered bacteria expressing any one or more of the described circuits for the consumption of kynurenine are administered sequentially, simultaneously, or subsequently to dosing with anti-PD1 antibody. In some embodiments, genetically engineered bacteria of expressing any one or more of the described circuits for the consumption of kynurenine are administered sequentially, simultaneously, or subsequently to dosing with an anti-CTLA4 antibody and anti-PD1 antibody. In some embodiments, genetically engineered bacteria expressing any one or more of the described circuits for the production of arginine are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, genetically engineered bacteria expressing any one or more of the described circuits for the production of arginine are administered sequentially, simultaneously, or subsequently to dosing with an anti-CTLA4 antibody. In some embodiments, genetically engineered bacteria expressing any one or more of the described circuits for the production of arginine are administered sequentially, simultaneously, or subsequently to dosing with anti-PD1 antibody. In some embodiments, genetically engineered bacteria of expressing any one or more of the described circuits for the production of arginine are administered sequentially, simultaneously, or subsequently to dosing with an anti-CTLA4 antibody and anti-PD1 antibody.

In some embodiments, the genetically engineered bacteria, e.g., adenosine consumer, and/or kynurenine consumer, and/or arginine producer, are able to improve anti-tumor activity (e.g., tumor proliferation, size, volume, weight) of the co-administered checkpoint inhibitors (e.g., PD-land/or CTLA-4), e.g., by 10%, 20%, 25%, 30%, 40%, 50%, 60%, 70%, 75%, 80%, 85%, 90%, 95%, or more as compared to a checkpoint inhibitor therapy alone under the same conditions or as compared to an unmodified bacteria of the same subtype under the same conditions. In some embodiments, the genetically engineered bacteria, e.g., adenosine consumer, and/or kynurenine consumer, and/or arginine producer, are able to improve anti-tumor activity (e.g., tumor proliferation, size, volume, weight) of the co-administered checkpoint inhibitors (e.g., PD-1 and/or CTLA-4), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the genetically engineered bacteria, e.g., adenosine consumer, and/or kynurenine consumer, and/or arginine producer, are able to improve anti-tumor activity (e.g., tumor proliferation, size, volume, weight) of the co-administered checkpoint inhibitor (e.g., PD-land/or CTLA-4), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, the bacteria genetically engineered to consume adenosine are able to improve anti-tumor activity (e.g., tumor proliferation, size, volume, weight) of the co-administered checkpoint inhibitors (e.g., PD-land/or CTLA-4), e.g., by 10%, 20%, 25%, 30%, 40%, 50%, 60%, 70%, 75%, 80%, 85%, 90%, 95%, or more as compared to a checkpoint inhibitor therapy alone under the same conditions or as compared to an unmodified bacteria of the same subtype under the same conditions. In some embodiments, the bacteria genetically engineered to consume adenosine are able to improve anti-tumor activity (e.g., tumor proliferation, size, volume, weight) of the co-administered checkpoint inhibitors (e.g., PD-land/or CTLA-4), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the bacteria genetically engineered to consume adenosine are able to improve anti-tumor activity (e.g., tumor proliferation, size, volume, weight) of the co-administered checkpoint inhibitor (e.g., PD-land/or CTLA-4), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, the bacteria genetically engineered to consume kynurenine are able to improve anti-tumor activity (e.g., tumor proliferation, size, volume, weight) of the co-administered checkpoint inhibitors (e.g., PD-land/or CTLA-4), e.g., by 10%, 20%, 25%, 30%, 40%, 50%, 60%, 70%, 75%, 80%, 85%, 90%, 95%, or more as compared to a checkpoint inhibitor therapy alone under the same conditions or as compared to an unmodified bacteria of the same subtype under the same conditions. In some embodiments, the bacteria genetically engineered to consume kynurenine are able to improve anti-tumor activity (e.g., tumor proliferation, size, volume, weight) of the co-administered checkpoint inhibitors (e.g., PD-1 and/or CTLA-4), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the bacteria genetically engineered to consume kynurenine are able to improve anti-tumor activity (e.g., tumor proliferation, size, volume, weight) of the co-administered checkpoint inhibitor (e.g., PD-1 and/or CTLA-4), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, the bacteria genetically engineered to produce arginine are able to improve anti-tumor activity (e.g., tumor proliferation, size, volume, weight) of the co-administered checkpoint inhibitors (e.g., PD-1 and/or CTLA-4), e.g., by 10%, 20%, 25%, 30%, 40%, 50%, 60%, 70%, 75%, 80%, 85%, 90%, 95%, or more as compared to a checkpoint inhibitor therapy alone under the same conditions or as compared to an unmodified bacteria of the same subtype under the same conditions. In some embodiments, the bacteria genetically engineered to produce arginine are able to improve anti-tumor activity (e.g., tumor proliferation, size, volume, weight) of the co-administered checkpoint inhibitors (e.g., PD-1 and/or CTLA-4), e.g., 1.0-1.2-fold, 1.2-1.4-fold, 1.4-1.6-fold, 1.6-1.8-fold, 1.8-2-fold, or two-fold more or more as compared to a chemotherapy alone under the same conditions or as compared to an unmodified bacteria of the same subtype under the same conditions. In some embodiments, the bacteria genetically engineered to produce arginine are able to improve anti-tumor activity (e.g., tumor proliferation, size, volume, weight) of the co-administered checkpoint inhibitor (e.g., PD-1 and/or CTLA-4), e.g., about three-fold, four-fold, about three-fold, four-fold, five-fold, six-fold, seven-fold, eight-fold, nine-fold, ten-fold, fifteen-fold, twenty-fold, thirty-fold, forty-fold, fifty-fold, hundred-fold, five hundred-fold, or one-thousand-fold more or more as compared to a chemotherapy alone under the same conditions or as compared to an unmodified bacteria of the same subtype under the same conditions.

In some embodiments, one or more engineered bacteria described herein, which comprise gene sequence(s) encoding anti-CD47 antibody for surface display, are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding anti-CD47 antibody for surface display, are administered sequentially, simultaneously, or subsequently to dosing with an anti-PD-1 antibody. In some embodiments, one or more engineered bacteria described herein, which comprise gene circuitry described herein for the increased production of arginine, are administered sequentially, simultaneously, or subsequently to dosing with an anti-PD-1 antibody. In some embodiments, the antibody is nivolumab. In some embodiments, the antibody is prembrolizumab. Other non-limiting examples of such anti-PD-1 antibodies are described herein.

In some embodiments, one or more engineered bacteria described herein, which comprise gene sequence(s) encoding anti-CD47 antibody for secretion are administered sequentially, simultaneously, or subsequently to dosing with an anti-PD-1 antibody. In some embodiments, one or more engineered bacteria described herein, which comprise gene sequence(s) encoding anti-CD47 antibody for surface display, are administered sequentially, simultaneously, or subsequently to dosing with an anti-PD-1 antibody. In some embodiments, one or more engineered bacteria described herein, which comprise gene circuitry described herein for the increased production of arginine, are administered sequentially, simultaneously, or subsequently to dosing with an anti-PD-1 antibody. In some embodiments, the antibody is nivolumab. In some embodiments, the antibody is prembrolizumab. Other non-limiting examples of such anti-PD-1 antibodies are described herein. In some embodiments, one or more engineered bacteria described herein, which comprise gene sequence(s) encoding anti-CD47 antibody for surface display or secretion in combination with gene circuitry for the increased production of arginine described herein, are administered sequentially, simultaneously, or subsequently to dosing with an anti-PD-1 antibody. In one embodiment, such a regimen comprising one or more genetically engineered bacteria which comprises circuitry for the production of arginine and for the secretion of anti-CD47, alone or in combination with a PD-1 antibody, e.g., nivolumab or prembrolizumab, is used for the treatment, management and prevention of advanced solid tumors. In some embodiments, the genetically engineered bacteria for the treatment of advanced solid tumors are administered orally. In some embodiments, the genetically engineered bacteria for the treatment of advanced solid tumors are administered systemically. In some embodiments, the genetically engineered bacteria for the treatment of advanced solid tumors are administered intratumorally. In any of these embodiments, the anti-PD-1 antibody is administered systemically or orally or intratumorally. In any of these embodiments, one or more arginine biosynthesis genes may be selected from argA, argB, argC, argD, argE, argF, argG, argH, argI, argJ, carA, and carB. In some embodiments, an arginine repressor (argR) is deleted, mutated, or modified so as to diminish or obliterate its repressor function. In some embodiments, the bacteria further comprise a gene encoding feedback resistant argA.

In some embodiments, one or more engineered bacteria described herein, which comprise gene sequence(s) encoding a soluble form of SIRPalpha for secretion are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding a soluble form of SIRPalpha for secretion are administered sequentially, simultaneously, or subsequently to dosing with an anti-PD-1 antibody. In some embodiments, one or more engineered bacteria described herein, which comprise gene circuitry described herein for the increased production of arginine, are administered sequentially, simultaneously, or subsequently to dosing with an anti-PD-1 antibody. In some embodiments, the antibody is nivolumab. In some embodiments, the antibody is prembrolizumab. Other non-limiting examples of such anti-PD-1 antibodies are described herein. In some embodiments, one or more engineered bacteria described herein, which comprise gene sequence(s) encoding a soluble form of SIRPalpha for secretion in combination with gene circuitry for the increased production of arginine described herein, are administered sequentially, simultaneously, or subsequently to dosing with an anti-PD-1 antibody. In one embodiment, such a regimen comprising one or more genetically engineered bacteria which comprises circuitry for the production of arginine and for the secretion of a soluble form of SIRPalpha, alone or in combination with a PD-1 antibody, e.g., nivolumab or prembrolizumab, is used for the treatment, management and prevention of advanced solid tumors. In some embodiments, the genetically engineered bacteria for the treatment of advanced solid tumors are administered orally. In some embodiments, the genetically engineered bacteria for the treatment of advanced solid tumors are administered systemically. In some embodiments, the genetically engineered bacteria for the treatment of advanced solid tumors are administered intratumorally. In any of these embodiments, the anti-PD-1 antibody is administered systemically or orally or intratumorally. In any of these embodiments, one or more arginine biosynthesis genes may be selected from argA, argB, argC, argD, argE, argF, argG, argH, argI, argJ, carA, and carB. In some embodiments, an arginine repressor (argR) is deleted, mutated, or modified so as to diminish or obliterate its repressor function. In some embodiments, the bacteria further comprise a gene encoding feedback resistant argA.

In some embodiments, one or more engineered bacteria described herein, which comprise gene sequence(s) encoding one or more cytokine(s) described herein for secretion into the extracellular environment, are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding one or more cytokine(s) described herein for secretion into the extracellular environment, are administered sequentially, simultaneously, or subsequently to dosing with an anti-PD-1 antibody. In some embodiments, one or more engineered bacteria described herein, which comprise gene sequence(s) encoding one or more enzymes for the degradation of kynurenine and optionally circuitry for the production of tryptophan, are administered sequentially, simultaneously, or subsequently to dosing with an anti-PD-1 antibody. Non-limiting examples of such anti-PD-1 antibodies are described herein. In some embodiments, one or more engineered bacteria described herein, which comprise gene sequence(s) encoding one or more cytokine(s) described herein for secretion in combination with gene sequence(s) encoding one or more enzymes for the degradation of kynurenine and optionally circuitry for the production of tryptophan, are administered sequentially, simultaneously, or subsequently to dosing with an anti-PD-1 antibody. Non-limiting examples of such anti-PD-1 antibodies are described herein, and include but are not limited to, pembrolizumab and nivolumab. In these embodiments, the anti-PD-1 antibody is administered systemically or orally or intratumorally. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of colorectal carcinoma in combination with the administration of a PD-1 antibody. In one embodiment, a regimen comprising one or more genetically engineered bacteria which produce one or more enzymes for the degradation of kynurenine (and optionally gene sequence(s) comprising circuitry for the production of tryptophan) and also produce one or more cytokine(s) described herein, alone or in combination with a PD-1 antibody, e.g., nivolumab or pembrolizumab, are used for the treatment, management and prevention of colorectal carcinoma. In one embodiment, the administration of the one or more genetically engineered bacteria is oral for the treatment of colorectal carcinoma. In one embodiment, the administration of the one or more genetically engineered bacteria is systemic for the treatment of colorectal carcinoma. In one embodiment, the administration of the one or more genetically engineered bacteria is intratumoral for the treatment of colorectal carcinoma. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of hepatocellular carcinoma in combination with the administration of a PD-1 antibody. In one embodiment, such a regimen comprising one or more genetically engineered bacteria which produce one or more enzymes for the degradation of kynurenine (and optionally gene sequence(s) comprising circuitry for the production of tryptophan) and produce one or more cytokine(s) described herein for secretion, alone or in combination with a PD-1 antibody, e.g., nivolumab or pembrolizumab, is used for the treatment, management and prevention of hepatocellular carcinoma. In one embodiment, the administration of one or more genetically engineered bacteria is oral for the treatment of hepatocellular carcinoma. In one embodiment, the administration of the one or more genetically engineered bacteria is systemic for the treatment of hepatocellular carcinoma. In one embodiment, the administration of the one or more genetically engineered bacteria is intratumoral for the treatment of hepatocellular carcinoma. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of advanced melanoma in combination with the administration of a PD-1 antibody. In one embodiment, a regimen comprising one or more genetically engineered bacteria which produce one or more enzymes for the degradation of kynurenine (and optionally gene sequence(s) comprising circuitry for the production of tryptophan) and secrete one or more cytokine(s) described herein, alone or in combination with a PD-1 antibody, e.g., nivolumab or prembrolizumab, are used for the treatment, management and prevention of immunotherapy-refractory advanced melanoma. In one embodiment, the administration of the one or more genetically engineered bacteria is oral for the treatment of advanced melanoma. In one embodiment, the administration of the one or more genetically engineered bacteria is intratumoral for the treatment of advanced melanoma. In one embodiment, the administration of the one or more genetically engineered bacteria is systemic for the treatment of advanced melanoma.

In some embodiments, one or more engineered bacteria described herein, which comprise gene sequence(s) encoding IL-15 for secretion into the extracellular environment, are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding IL-15 for secretion into the extracellular environment, are administered sequentially, simultaneously, or subsequently to dosing with an anti-PD-1 antibody. In some embodiments, one or more engineered bacteria described herein, which comprise gene sequence(s) encoding IL-15 in combination with gene sequence(s) encoding one or more enzymes for the degradation of kynurenine (and optionally for the production of tryptophan), are administered sequentially, simultaneously, or subsequently to dosing with an anti-PD-1 antibody. Non-limiting examples of such anti-PD-1 antibodies are described herein, and include pembrolizumab and nivolumab. In these embodiments, the anti-PD-1 antibody is administered systemically or orally or intratumorally. In some embodiments, the one or more genetically engineered bacteria comprising gene sequence(s) encoding either enzymes for the degradation of kynurenine (and optionally gene sequence(s) comprising circuitry for the production of tryptophan) or IL-15 for secretion, or both, may be used for the treatment of colorectal carcinoma in combination with the administration of a PD-1 antibody. In one embodiment, a regimen comprising one or more genetically engineered bacteria which produce one or more enzymes for the degradation of kynurenine (and optionally gene sequence(s) comprising circuitry for the production of tryptophan) and also produce IL-15, alone or in combination with a PD-1 antibody, e.g., nivolumab or pembrolizumab, are used for the treatment, management and prevention of colorectal carcinoma. In one embodiment, the administration of the one or more genetically engineered bacteria is oral for the treatment of colorectal carcinoma. In one embodiment, the administration of the one or more genetically engineered bacteria is systemic for the treatment of colorectal carcinoma. In one embodiment, the administration of the one or more genetically engineered bacteria is intratumoral for the treatment of colorectal carcinoma. In some embodiments, the one or more genetically engineered bacteria comprising gene sequence(s) encoding either enzymes for the degradation of kynurenine (and optionally gene sequence(s) comprising circuitry for the production of tryptophan) or IL-15 or both, may be used for the treatment of hepatocellular carcinoma in combination with the administration of a PD-1 antibody. In one embodiment, such a regimen comprising one or more genetically engineered bacteria which produce one or more enzymes for the degradation of kynurenine (and optionally gene sequence(s) comprising circuitry for the production of tryptophan) and produce IL-15 for secretion, alone or in combination with a PD-1 antibody, e.g., nivolumab or pembrolizumab, is used for the treatment, management and prevention of hepatocellular carcinoma. In one embodiment, the administration of one or more genetically engineered bacteria is oral for the treatment of hepatocellular carcinoma. In one embodiment, the administration of the one or more genetically engineered bacteria is systemic for the treatment of hepatocellular carcinoma. In one embodiment, the administration of the one or more genetically engineered bacteria is intratumoral for the treatment of hepatocellular carcinoma. In some embodiments, the one or more genetically engineered bacteria comprising gene sequence(s) encoding either enzymes for the degradation of kynurenine (and optionally gene sequence(s) comprising circuitry for the production of tryptophan) or IL-15 for secretion, or both, may be used for the treatment of advanced melanoma in combination with the administration of a PD-1 antibody. In one embodiment, a regimen comprising one or more genetically engineered bacteria which produce one or more enzymes for the degradation of kynurenine (and optionally gene sequence(s) comprising circuitry for the production of tryptophan) and secrete IL-15, alone or in combination with a PD-1 antibody, e.g., nivolumab or prembrolizumab, are used for the treatment, management and prevention of immunotherapy-refractory advanced melanoma. In one embodiment, the administration of the one or more genetically engineered bacteria is oral for the treatment of advanced melanoma. In one embodiment, the administration of the one or more genetically engineered bacteria is intratumoral for the treatment of advanced melanoma. In one embodiment, the administration of the one or more genetically engineered bacteria is systemic for the treatment of advanced melanoma.

In some embodiments, one or more engineered bacteria described herein, which comprise gene sequence(s) encoding anti-CD47 antibody for secretion are administered sequentially, simultaneously, or subsequently to dosing with checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding anti-CD47 antibody for secretion are administered sequentially, simultaneously, or subsequently to dosing with an anti-PD-L1 antibody. In some embodiments, one or more engineered bacteria described herein, which comprise gene sequence(s) encoding anti-CD47 antibody for surface display, are administered sequentially, simultaneously, or subsequently to dosing with an anti-PD-L1 antibody. In some embodiments, one or more engineered bacteria described herein, which comprise gene circuitry described herein for the increased production of arginine, are administered sequentially, simultaneously, or subsequently to dosing with an anti-PD-L1 antibody. In some embodiments, the antibody is durvalumab. In some embodiments, the antibody is avelumab. In some embodiments, the antibody is atezolizumab. Other non-limiting examples of such anti-PD-L1 antibodies are described herein. In some embodiments, one or more engineered bacteria described herein, which comprise gene sequence(s) encoding anti-CD47 antibody for surface display or secretion in combination with gene circuitry for the increased production of arginine described herein, are administered sequentially, simultaneously, or subsequently to dosing with an anti-PD-L1 antibody. In one embodiment, such a regimen comprising one or more genetically engineered bacteria which comprises circuitry for the production of arginine and for the secretion of anti-CD47, alone or in combination with a PD-L1 antibody, e.g., durvalumab, avelumab or atezolizumab, is used for the treatment, management and prevention of advanced solid tumors. In some embodiments, the genetically engineered bacteria for the treatment of advanced solid tumors are administered orally. In some embodiments, the genetically engineered bacteria for the treatment of advanced solid tumors are administered systemically. In some embodiments, the genetically engineered bacteria for the treatment of advanced solid tumors are administered intratumorally. In any of these embodiments, the anti-PD-L1 antibody is administered systemically or orally or intratumorally.

In some embodiments, one or more engineered bacteria described herein, which comprise gene sequence(s) encoding one or more cytokine(s) described herein for secretion into the extracellular environment, are administered sequentially, simultaneously, or subsequently to dosing with a checkpoint inhibitor, e.g., as described herein and known in the art, including but not limited to anti-PD-1, anti-PD-L1, and anti-CTLA-4. In some embodiments, one or more engineered bacteria described herein, which comprise gene sequence(s) encoding one or more cytokine(s) described herein for secretion into the extracellular environment, are administered sequentially, simultaneously, or subsequently to dosing with an anti-PD-L1 antibody. In some embodiments, one or more engineered bacteria described herein, which comprise gene sequence(s) encoding one or more enzymes for the degradation of kynurenine and optionally the production of tryptophan, are administered sequentially, simultaneously, or subsequently to dosing with an anti-PD-L1 antibody. Non-limiting examples of such anti-PD-L1 antibodies are described herein. In some embodiments, one or more engineered bacteria described herein, which comprise gene sequence(s) encoding one or more cytokine(s) described herein for secretion in combination with gene sequence(s) encoding one or more enzymes for the degradation of kynurenine and optionally the production of tryptophan, are administered sequentially, simultaneously, or subsequently to dosing with an anti-PD-L1 antibody. Non-limiting examples of such anti-PD-L1 antibodies are described herein, and include but are not limited to, durvalumab, avelumab, or atezolizumab. In these embodiments, the anti-PD-L1 antibody is administered systemically or orally or intratumorally. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of colorectal carcinoma in combination with the administration of a PD-L1 antibody. In one embodiment, a regimen comprising one or more genetically engineered bacteria which produce one or more enzymes for the degradation of kynurenine (and optionally gene sequence(s) comprising circuitry for the production of tryptophan) and also produce one or more cytokine(s) described herein, alone or in combination with a PD-L1 antibody, e.g., durvalumab, avelumab, or atezolizumab, are used for the treatment, management and prevention of colorectal carcinoma. In one embodiment, the administration of the one or more genetically engineered bacteria is oral for the treatment of colorectal carcinoma. In one embodiment, the administration of the one or more genetically engineered bacteria is systemic for the treatment of colorectal carcinoma. In one embodiment, the administration of the one or more genetically engineered bacteria is intratumoral for the treatment of colorectal carcinoma. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of hepatocellular carcinoma in combination with the administration of a PD-L1 antibody. In one embodiment, such a regimen comprising one or more genetically engineered bacteria which produce one or more enzymes for the degradation of kynurenine (and optionally gene sequence(s) comprising circuitry for the production of tryptophan) and produce one or more cytokine(s) described herein for secretion, alone or in combination with a PD-L1 antibody, e.g., durvalumab, avelumab, or atezolizumab, is used for the treatment, management and prevention of hepatocellular carcinoma. In one embodiment, the administration of one or more genetically engineered bacteria is oral for the treatment of hepatocellular carcinoma. In one embodiment, the administration of the one or more genetically engineered bacteria is systemic for the treatment of hepatocellular carcinoma. In one embodiment, the administration of the one or more genetically engineered bacteria is intratumoral for the treatment of hepatocellular carcinoma. In some embodiments, the one or more genetically engineered bacteria comprising gene sequence(s) encoding either enzymes for the degradation of kynurenine (and optionally gene sequence(s) comprising circuitry for the production of tryptophan) or one or more cytokine(s) described herein, or both, may be used for the treatment of advanced melanoma in combination with the administration of a PD-L1 antibody. In one embodiment, a regimen comprising one or more genetically engineered bacteria which produce one or more enzymes for the degradation of kynurenine (and optionally gene sequence(s) comprising circuitry for the production of tryptophan) and secrete one or more cytokine(s) described herein, alone or in combination with a PD-L1 antibody, e.g., durvalumab, avelumab, or atezolizumab, are used for the treatment, management and prevention of immunotherapy-refractory advanced melanoma. In one embodiment, the administration of the one or more genetically engineered bacteria is oral for the treatment of advanced melanoma. In one embodiment, the administration of the one or more genetically engineered bacteria is intratumoral for the treatment of advanced melanoma. In one embodiment, the administration of the one or more genetically engineered bacteria is systemic for the treatment of advanced melanoma.

In some embodiments, one or more engineered bacteria described herein, which comprise gene sequence(s) encoding IL-15 for secretion into the extracellular environment, are administered sequentially, simultaneously, or subsequently to dosing with an anti-PD-L1 antibody. In some embodiments, one or more engineered bacteria described herein, which comprise gene sequence(s) encoding IL-15 in combination with gene sequence(s) encoding one or more enzymes for the degradation of kynurenine (and optionally for the production of tryptophan), are administered sequentially, simultaneously, or subsequently to dosing with an anti-PD-L1 antibody. Non-limiting examples of such anti-PD-L1 antibodies are described herein, and include durvalumab, avelumab, and atezolizumab. In these embodiments, the anti-PD-L1 antibody is administered systemically or orally or intratumorally. In some embodiments, the one or more genetically engineered bacteria comprising gene sequence(s) encoding either enzymes for the degradation of kynurenine (and optionally gene sequence(s) comprising circuitry for the production of tryptophan) or IL-15 for secretion, or both, may be used for the treatment of colorectal carcinoma in combination with the administration of a PD-L1 antibody. In one embodiment, a regimen comprising one or more genetically engineered bacteria which produce one or more enzymes for the degradation of kynurenine (and optionally gene sequence(s) comprising circuitry for the production of tryptophan) and also produce IL-15, alone or in combination with a PD-L1 antibody, e.g., durvalumab, avelumab, or atezolizumab, are used for the treatment, management and prevention of colorectal carcinoma. In one embodiment, the administration of the one or more genetically engineered bacteria is oral for the treatment of colorectal carcinoma. In one embodiment, the administration of the one or more genetically engineered bacteria is systemic for the treatment of colorectal carcinoma. In one embodiment, the administration of the one or more genetically engineered bacteria is intratumoral for the treatment of colorectal carcinoma. In some embodiments, the one or more genetically engineered bacteria comprising gene sequence(s) encoding either enzymes for the degradation of kynurenine (and optionally gene sequence(s) comprising circuitry for the production of tryptophan) or IL-15 or both, may be used for the treatment of hepatocellular carcinoma in combination with the administration of a PD-L1 antibody. In one embodiment, such a regimen comprising one or more genetically engineered bacteria which produce one or more enzymes for the degradation of kynurenine (and optionally gene sequence(s) comprising circuitry for the production of tryptophan) and produce IL-15 for secretion, alone or in combination with a PD-L1 antibody, e.g., durvalumab, avelumab, or atezolizumab, is used for the treatment, management and prevention of hepatocellular carcinoma. In one embodiment, the administration of one or more genetically engineered bacteria is oral for the treatment of hepatocellular carcinoma. In one embodiment, the administration of the one or more genetically engineered bacteria is systemic for the treatment of hepatocellular carcinoma. In one embodiment, the administration of the one or more genetically engineered bacteria is intratumoral for the treatment of hepatocellular carcinoma. In some embodiments, the one or more genetically engineered bacteria comprising gene sequence(s) encoding either enzymes for the degradation of kynurenine (and optionally gene sequence(s) comprising circuitry for the production of tryptophan) or IL-15 for secretion, or both, may be used for the treatment of advanced melanoma in combination with the administration of a PD-L1 antibody. In one embodiment, a regimen comprising one or more genetically engineered bacteria which produce one or more enzymes for the degradation of kynurenine (and optionally gene sequence(s) comprising circuitry for the production of tryptophan) and secrete IL-15, alone or in combination with a PD-L1 antibody, e.g., durvalumab, avelumab, or atezolizumab, are used for the treatment, management and prevention of immunotherapy-refractory advanced melanoma. In one embodiment, the administration of the one or more genetically engineered bacteria is oral for the treatment of advanced melanoma. In one embodiment, the administration of the one or more genetically engineered bacteria is intratumoral for the treatment of advanced melanoma. In one embodiment, the administration of the one or more genetically engineered bacteria is systemic for the treatment of advanced melanoma.

In some embodiments, the genetically engineered microorganisms may be administered as part of a regimen, which includes other treatment modalities or combinations of other modalities. Non-limiting examples of these modalities or agents are conventional therapies (e.g., radiotherapy, chemotherapy), other immunotherapies, stem cell therapies, and targeted therapies, (e.g., BRAF or vascular endothelial growth factor inhibitors; antibodies or compounds), bacteria described herein, and oncolytic viruses. Therapies also include related to antibody-immune engagement, including Fc-mediated ADCC therapies, therapies using bispecific soluble scFvs linking cytotoxic T cells to tumor cells (e.g., BiTE), and soluble TCRs with effector functions. Immunotherapies include vaccines (e.g., viral antigen, tumor associated antigen, neoantigen, or combinations thereof), checkpoint inhibitors, cytokine therapies, adoptive cellular therapy (ACT). ACT includes but is not limited to, tumor infiltrating lymphocyte (TIL) therapies, native or engineered TCR or CAR-T therapies, natural killer cell therapies, and dendritic cell vaccines or other vaccines of other antigen presenting cells. Targeted therapies include antibodies and chemical compounds, and include for example antiangiogenic strategies and BRAF inhibition.

The immunostimulatory activity of bacterial DNA is mimicked by synthetic oligodeoxynucleotides (ODNs) expressing unmethylated CpG motifs. Bode et al., Expert Rev Vaccines. 2011 April; 10(4): 499-511. CpG DNA as a vaccine adjuvant. When used as vaccine adjuvants, CpG ODNs improve the function of professional antigen-presenting cells and boost the generation of humoral and cellular vaccine-specific immune responses. In some embodiments, CpG can be administered in combination with the genetically engineered bacteria of the invention.

In one embodiment, the genetically engineered microorganisms are administered in combination with tumor cell lysates.

The dosage of the pharmaceutical composition and the frequency of administration may be selected based on the severity of the symptoms and the progression of the cancer. The appropriate therapeutically effective dose and the frequency of administration can be selected by a treating clinician.

Treatment In Vivo

The genetically engineered bacteria may be evaluated in vivo, e.g., in an animal model. Any suitable animal model of a disease or condition associated with cancer may be used, e.g., a tumor syngeneic or xenograft mouse models (see, e.g., Yu et al., 2015). The genetically engineered bacteria may be administered to the animal systemically or locally, e.g., via oral administration (gavage), intravenous, or subcutaneous injection or via intratumoral injection, and treatment efficacy determined, e.g., by measuring tumor volume.

Non-limiting examples of animal models include mouse models, as described in Dang et al., 2001, Heap et al., 2014 and Danino et al., 2015).

Pre-clinical mouse models determine which immunotherapies and combination immunotherapies will generate the optimal therapeutic index (maximal anti-tumor efficacy and minimal immune related adverse events (irAEs)) in different cancers.

Implantation of cultured cells derived from various human cancer cell types or a patient's tumor mass into mouse tissue sites has been widely used for generations of cancer mouse models (xenograft modeling). In xenograft modeling, human tumors or cell lines are implanted either subcutaneously or orthotopically into immune-compromised host animals (e.g., nude or SCID mice) to avoid graft rejection. Because the original human tumor microenvironment is not recapitulated in such models, the activity of anti-cancer agents that target immune modulators may not be accurately measured in these models, making mouse models with an intact immune system more desirable.

Accordingly, implantation of murine cancer cells in a syngeneic immunocompetent host (allograft) are used to generate mouse models with tumor tissues derived from the same genetic background as a given mouse strain. In syngeneic models, the host immune system is normal, which may more closely represent the real life situation of the tumor's micro-environment. The tumor cells or cancer cell lines are implanted either subcutaneously or orthotopically into the syngeneic immunocompetent host animal (e.g., mouse). Representative murine tumor cell lines, which can be used in syngeneic mouse models for immune checkpoint benchmarking include, but are not limited to the cell lines listed in Table 18.

TABLE 18

Selected cell lines for use in syngeneic mouse models

| Cancer Types | Cell Lines |
|---|---|
| Bladder | MBT-2 |
| Breast | 4T1, EMT6, JC |
| Colon | CT-26, Colon26, MC38 |
| Kidney | Renca |
| Leukemia | L1210, C1498 |
| Mastocytoma P815 | P815 |
| Neuroblastoma Neuro-2-A | Neuro-2a |
| Myeloma | MPC-11 |
| Liver | H22 |
| Lung | LL/2, KLN205 |
| Lymphoma | A20, EL4, P388D1, L15178-R, E.G7-OVA |
| Melanoma | B16-BL6, B16-F10, S91 |
| Pancreatic | Pan02 |
| Prostate | RM-1 |
| Fibrosarcoma | WHI-164 |
| Plasmacytoma | J558 |

Additional cell lines include, but are not limited to those in Table 19, which are described with respect to CTLA-4 benchmarking in Joseph F. Grosso and Maria N. Jure-Kunkel et al., 2013, the contents of which is herein incorporated by reference in its entirety.

TABLE 19

Murine cell lines and CTLA-4 antibodies for syngenic mouse models

| Murine Tumor | Tumor type/Mouse strain | Anti-CTLA-4 Ab/Tx regimen |
|---|---|---|
| Brain | SMA-560 Glioma/Vm/Dk) | 9H10; d7* (100 µg), d10 (50 µg), d13 (50 µg) post-implant |
| | GL-261 Glioma/C57BL/6) | 9H10; d0 (100 µg), d3 (50 µg), d6 (50 µg), |
| Ovarian | OV-HM/C57BL/6 × C3H/He) | UC10-4F10-11; 1 mg/mouse |
| Bladder | MB49/C57BL/6 | 9D9; d7, d10, d13 (200 µg each) |
| Sarcoma | Meth-A/BALB/c | 9H10; d6 (100 µg), d9 (50 µg), d12 (50 µg) |
| | MC38, 11A1 BALB/c, C57BL/6 | 9H10; d14 (100 µg), d17 (50 µg), d20 (50 µg) |
| Breast | TSA/BALB/c (62 | 9H10; d12, d14, d16 (200 µg each) |
| | 4T1 BALB/c | 9H10; d14, d18, d21 (200 µg each) |
| | 4T1 BALB/c | 9H10; d14, d18, d21 (200 µg each) |
| | 4T1 BALB/c | UC10-4F10-11; d7, d11, d15, d19 (100 µg each) |
| | SM1/BALB/c | 9H10; d4, d7, d10 (100 µg each) |
| | EMT6/BALB/c | UC10-4F10-11; d4, d8, d12 (400 µg each) lxa: d3, d7, d11 |
| Colon | MC38/C57BL/6 | UC10-4F10-11; d7, d11, d16 (100 µg each) |
| | MC38 | K4G4, L1B11, L3D10 |
| | CT26 BALB/c | 9H10; d10 (100 µg), d13 (50 µg), d15 (50 µg) |
| | CT26 BALB/c | UC10-4F10-11; d5, d9, d13 (400 µg each) lxa: d4, d8, d12 |
| | MC38/C57BL/6 | UC10-4F10-11; d14, d21, d28 (800 µg each) |
| Lymphoma | BW5147.3/AKR | UC10-4F10-11; d-1 (250 µg), d0 (250 µg), d4 [100 µg), d8 (100 µg), dI2 (100 µg) |
| | EL4/C57BL/6 | 9H10; d3, d5 (100 µg each) |
| Fibrosarcoma | SA1N/A/J | 9H10; every 4 days (200 µg each) |
| | SA1N | UC10-4F10-11; d12, d16, d20 (400 µg each) lxa: d11, d15, d15 |
| Prostata | TRAMP C1[pTC1]/C57BU6 | 9H10; d7, d10, d13 (100 µg each) |
| | TRAMP C2/C57BL/6 | 9H10; d4, d7, d10 (100 µg each) |
| | TRAMP/C57BL | 9H10; 14-16 week old mice d7, d10, d16 post-tR tx (100 µg each) |
| | TRAMP C2/C57BL/6 | 9H10; d29, d33, d40, d50 (100 µg each) d29 = 1 d post-cryoablation |
| Melanoma | B16/C57BL/6 | 9H10; d0, d3, d6 (200 µg each) |
| | B16/C57BL/6 | 9H10; d6 (100 µg), d8 [50 µg), d10 (50 µg) |
| | B16/C57BL/6 | 9D9; d3, d6, d9 |
| | B16/C57BL/6 | 9H10; d3, d6, d9 (100 µg each) |
| | B16.F10/C57BL/6 | 9H10; d5 (100 µg), d7 (50 µg), d9 (50 µg) |
| Lung | M109/BALB/c | UC10-4F10-11; d4, d8, d12(400 µg each) lxa: d3, d7, d11 |
| Plasmacytoma | MOPC-315/BALB/c ANnCrlBr | UC10-4F10-11; 20 mm tumors tx daily for 10 days (100 µg each) |

For tumors derived from certain cell lines, ovalbumin can be added to further stimulate the immune response, thereby increasing the response baseline level.

Examples of mouse strains that can be used in syngeneic mouse models, depending on the cell line include C57BL/6, FVB/N, Balb/c, C3H, HeJ, C3H/HeJ, NOD/ShiLT, A/J, 129S1/SvlmJ, NOD. Additionally, several further genetically engineered mouse strains have been reported to mimic human tumorigenesis at both molecular and histologic levels. These genetically engineered mouse models also provide excellent tools to the field and additionally, the cancer cell lines derived from the invasive tumors developed in these models are also good resources for cell lines for syngeneic tumor models Examples of genetically engineered strains are provided in Table 20.

TABLE 20

Exemplary genetic engineered mouse strains of interest

| Animal strain | Strain | Predicted cancer |
|---|---|---|
| C57BL/6-Tg(TRAMP)8247Ng/JNju | C57BL/6 | Prostate cancer |
| FVB/N-Tg☐MMTV-PyVT)634Mul/Jnju | FVB/N | Breast cancer |
| C57BL/6J-Apc$^{Min}$/JNju | C57BL/6 | Colorectal cancer |
| STOCK Ptch1$^{tm1MPs}$/JNju | C57BL/6JNju | Medulloblastoma |
| NOD-$_{Prkdc}$em26Cd52$_{Il2rg}$em26Cd22$_{Nju}$ | NOD/ShiLt | Not specific |
| C57BL/6J-Apc$^{Min}$/JNju | C57BL/6 | Colorectal cancer |
| BALB/cJnju | BALB/c | Lung cancer |
| C3H/HeJNju (Urethane induced lung cancer model) | C3H/HeJ | Lung cancer |
| A/JNju | A/J | Lung cancer |
| A/Jnju (Urethane induced lung cancer model) | A/J | Lung cancer |
| C3H/HeJSlac | C3H/HeJ | Lung cancer |

TABLE 20-continued

Exemplary genetic engineered mouse strains of interest

| Animal strain | Strain | Predicted cancer |
|---|---|---|
| 129S1/SvImJNju (Urethane induced lung cancer | 129S1/SvImJ | Lung cancer |
| $_{Kras}$LSL-G12D/WT | C57BL/6 | Lung cancer |
| $_{Kras}$LSL-G12D/WT; $_{p53}$KO/KO | C57BL/6 | Lung cancer |
| $_{Pdx1\text{-}cre;Kras}$LSL-G12D/WT,$_{p53}$KO/KO | C57BL/6 | Pancreatic cancer |
| $_{Kras}$LSL-G12D/WT; $_{P16}$KO/KO | C57BL/6; FVB/N | Pancreatic cancer; Lung cancer |
| $_{Kras}$LSL-G12D/WT,$_{PTEN}$CKO/CKO | C57BL/6 | Ovarian cancer; |
| $_{Pbsn\text{-}cre;Kras}$LSL-G12D/WT $_{PTEN}$CKO/CKO | C57BL/6 | Prostate cancer |
| $_{p53}$KO/KO,$_{PTEN}$CKO/CKO | C57BL/6 | Prostate cancer |
| $_{Pbsn\text{-}cre;PTEN}$CKO/CKO | C57BL/6 | Prostate cancer |
| NOD | NOD | Leukemia |
| B6.Cg-Tg(IghMyc)22Bri/JNju | C57BL/6 | B cell Lymphoma |
| $_{PTEN}$CKO/CKO | C57BL/6 | Ovarian cancer (Female); Prostate cancer (Male); Tes/s cancer (Male) |
| NASH-HCC (Streptozotocin and high-fat diet induced liver cancer model) | C57BL/6 | Hepatocellular Carcinoma |
| BALB/c nude | BALB/c | Not specific |
| C3H/He | C3H/He | Hepatocellular Carcinoma |
| B6N | C57BL/6 | Not specific |
| B6/N-Akr1c12$^{tm1a}$Nju | C57BL/6 | Not specific |
| P53 null from VitalStar | C57BL/6 | Not specific |
| P53 null from VitalStar | C57BL/6 | Not specific |
| P53 null from VitalStar | C57BL/6 | Not specific |
| $_{Pdx1\text{-}cre;Kras}$LSL-G12D/WT,$_{p53}$KO/KO | C57BL/6 | Pancreatic cancer |
| $_{Kras}$LSL-G12D/WT; $_{P16}$KO/KO | C57BL/6; FVB/N | Pancreatic cancer; Lung cancer |
| $_{Kras}$LSL-G12D/WT,$_{PTEN}$CKO/CKO | C57BL/6 | Ovarian cancer; |
| $_{Kras}$LSL-G12D/WT,$_{PTEN}$CKO/CKO | C57BL/6 | Prostate cancer; |
| $_{Kras}$LSL-G12D/WT,$_{PTEN}$CKO/CKO | C57BL/6 | Brain cancer |
| $_{Pbsn\text{-}cre;Kras}$LSL-G12D/WT $_{PTEN}$CKO/CKO | C57BL/6 | Prostate cancer |
| $_{p53}$KO/KO,$_{PTEN}$CKO/CKO | C57BL/6 | Prostate cancer |
| $_{Pbsn\text{-}cre;PTEN}$CKO/CKO | C57BL/6 | Prostate cancer |
| $_{Kras}$LSL-G12D/WT | C57BL/6 | Lung cancer |
| NOD | NOD | Leukemia |
| B6.Cg-Tg(IghMyc)22Bri/JNju | C57BL/6 | B cell Lymphoma |
| $_{PTEN}$CKO/CKO | C57BL/6 | Ovarian cancer (Female); Prostate |
| NASH-HCC (Streptozotocin and high-fat diet induced liver cancer model) | C57BL/6 | Hepatocellular Carcinoma |
| BALB/c nude | BALB/c | Not specific |
| C3H/He | C3H/He | Hepatocellular |
| B6N | C57BL/6 | Not specific |
| B6/N-Akr1c12$^{tm1a}$Nju | C57BL/6 | Not specific |
| P53 null from VitalStar | C57BL/6 | Not specific |
| P53 null from VitalStar | C57BL/6 | Not specific |
| P53 null from VitalStar | C57BL/6 | Not specific |
| $_{Kras}$LSL-G12D/WT; $_{p53}$KO/KO | C57BL/6 | Not specific |

Often antibodies directed against human proteins do not detect their murine counterparts. In studying antibodies, including those directed against human immune checkpoint molecules, it is necessary to take this in consideration. For example, Ipilimumab did not show cross-reactivity with or binding to CTLA-4 from rats, mice or rabbits.

In some cases, mice transgenic for the gene of interest can used to overcome this issue, as was done for ipilimumab. However, in syngeneic mouse models without a human transgene, mouse protein reactive antibodies must be used to test therapeutic antibody strategies. For example, suitable CTLA-4 antibodies for expression by the genetically engineered bacteria of interest include, but are not limited to, 9H10, UC10-4F10-11, 9D9, and K4G4 (Table 33).

More recently, "humanized" mouse models have been developed, in which immunodeficient mice are reconstituted with a human immune system, and which have helped overcome issues relating to the differences between the mouse and human immune systems, allowing the in vivo study of human immunity. Severely immunodeficient mice which combine the IL2receptor null and the severe combined immune deficiency mutation (scid) (NOD-scid IL2Rgnull mice) lack mature T cells, B cells, or functional NK cells, and are deficient in cytokine signaling. These mice can be engrafted with human hematopoietic stem cells and peripheral-blood mononuclear cells. CD34+ hematopoietic stem cells (hu-CD34) are injected into the immune deficient mice, resulting in multi-lineage engraftment of human immune cell populations including very good T cell maturation and function for long-term studies. This model has a research span of 12 months with a functional human immune system displaying T-cell dependent inflammatory responses with no donor cell immune reactivity towards the host. Patient derived xenografts can readily be implanted in these models and the effects of immune modulatory agents studied in an in vivo setting more reflective of the human tumor microenvironment (both immune and non-immune cell-based) (Baia et al., 2015).

Human cell lines of interest for use in the humanized mouse models include but are not limited to HCT-116 and HT-29 colon cancer cell lines.

A rat F98 glioma model and the utility of spontaneous canine tumors, as described in Roberts et al 2014, the contents of each of which are herein incorporated by reference in their entireties. Locally invasive tumors generated by implantation of F98 rat glioma cells engineered to express luciferase were intratumorally injected with *C. novyi*-NT spores, resulting in germination and a rapid fall in luciferase activity. *C. novyi*-NT germination was demonstrated by the appearance of vegetative forms of the bacterium. In these studies, *C. novyi*-NT precisely honed to the tumor sparing neighboring cells.

Canine soft tissue sarcomas for example are common in many breeds and have clinical, histopathological, and genetically features similar to those in humans (Roberts et al, 2014; Staedtke et al., 2015), in particular, in terms of genetic alterations and spectrum of mutations. Roberts et al. conducted a study in dogs, in which *C. novyi*-NT spores were intratumorally injected ($1 \times 10^8$ *C. novyi*-NT spores) into spontaneously occurring solid tumors in one to 4 treatment cycles and followed for 90 days. A potent inflammatory response was observed, indicating that the intratumoral injections mounted an innate immune response.

In some embodiments, the genetically engineered microorganisms of the invention are administered systemically, e.g., orally, subcutaneously, intravenously or intratumorally into any of the models described herein to assess anti-tumor efficacy and any treatment related adverse side effects.

FULL CITATIONS

Full citations or the references cited throughout the specification include:

1. Agarwala. Practical approaches to immunotherapy in the clinic. Semin Oncol. 2015 December; 42 Suppl 3:S20-S27. PMID: 26598056.
2. Agata et al. Expression of the PD-1 antigen on the surface of stimulated mouse T and B lymphocytes. Int Immunol. 1996 May; 8(5):765-772. PMID: 8671665.
3. Altenhoefer et al. The probiotic *Escherichia coli* strain Nissle 1917 interferes with invasion of human intestinal epithelial cells by different enteroinvasive bacterial pathogens. FEMS Immunol Med Microbiol. 2004 Apr. 9; 40(3):223-229. PMID: 15039098.
4. Andersen et al. Uracil uptake in *Escherichia coli* K-12: isolation of uraA mutants and cloning of the gene. J Bacteriol. 1995 April; 177(8):2008-2013. PMID: 7721693.
5. Arthur et al. Intestinal inflammation targets cancer-inducing activity of the microbiota. Science. 2012 Oct. 5; 338(6103):120-123. PMID: 22903521.
6. Arai et al. Expression of the nir and nor genes for denitrification of *Pseudomonas aeruginosa* requires a novel CRP/FNR-related transcriptional regulator, DNR, in addition to ANR. FEBS Lett. 1995 Aug. 28; 371(1): 73-76. PMID: 7664887.
7. Bettegowda et al. Overcoming the hypoxic barrier to radiation therapy with anaerobic bacteria. Proc Natl Acad Sci USA. 2003 Dec. 9; 100(25):15083-15088. PMID: 14657371.
8. Brown et al. Exploiting tumour hypoxia in cancer treatment. Nat Rev Cancer. 2004 June; 4(6):437-447. PMID: 15170446.
9. Callura et al. Tracking, tuning, and terminating microbial physiology using synthetic riboregulators. Proc Natl Acad Sci USA. 2010 Sep. 7; 107(36):15898-15903. PMID: 20713708.
10. Castiglione et al. The transcription factor DNR from *Pseudomonas aeruginosa* specifically requires nitric oxide and haem for the activation of a target promoter in *Escherichia coli*. Microbiology. 2009 September; 155(Pt 9):2838-2844. PMID: 19477902.
11. Cronin et al. High resolution in vivo bioluminescent imaging for the study of bacterial tumour targeting." PLoS One. 2012; 7(1):e30940. PMID: 22295120.
12. Cuevas-Ramos et al. *Escherichia coli* induces DNA damage in vivo and triggers genomic instability in mammalian cells. Proc Natl Acad Sci USA. 2010 Jun. 22; 107(25):11537-11542. PMID: 20534522.
13. Dang et al. Combination bacteriolytic therapy for the treatment of experimental tumors. Proc Natl Acad Sci USA. 2001 Dec. 18; 98(26):15155-60. PMID: 11724950.
14. Danino et al. Programmable probiotics for detection of cancer in urine. Sci Transl Med. 2015 May 27; 7(289): 289ra84. PMID: 26019220.
15. Deutscher. The mechanisms of carbon catabolite repression in bacteria. Curr Opin Microbiol. 2008 April; 11(2): 87-93. PMID: 18359269.
16. Dinleyici et al. *Saccharomyces boulardii* CNCM I-745 in different clinical conditions. Expert Opin Biol Ther. 2014 November; 14(11):1593-1609. PMID: 24995675.
17. Eiglmeier et al. Molecular genetic analysis of FNR-dependent promoters. Mol Microbiol. 1989 July; 3(7): 869-878. PMID: 2677602.
18. Follows et al. Study of the interaction of the medium chain mu 2 subunit of the clathrin-associated adapter protein complex 2 with cytotoxic T-lymphocyte antigen 4 and CD28. Biochem J. 2001 Oct. 15; 359(Pt 2):427-434. PMID: 11583591.
19. Forbes. Profile of a bacterial tumor killer. Nat Biotechnol. 2006 December; 24(12):1484-1485. PMID: 17160044.
20. Galimand et al. Positive FNR-like control of anaerobic arginine degradation and nitrate respiration in *Pseudomonas aeruginosa*. J Bacteriol. 1991 March; 173(5):1598-1606. PMID: 1900277.
21. Gardner et al. Construction of a genetic toggle switch in *Escherichia coli*. Nature. 2000; 403:339-342. PMID: 10659857.
22. Görke et al. Carbon catabolite repression in bacteria: many ways to make the most out of nutrients. Nat Rev Microbiol. 2008 August; 6(8):613-624. PMID: 18628769.
23. Griffin et al. Blockade of T cell activation using a surface-linked single-chain antibody to CTLA-4 (CD152). J Immunol. 2000 May 1; 164(9):4433-42. PMID: 10779742.
24. Groot et al. Functional antibodies produced by oncolytic clostridia. Biochem Biophys Res Commun. 2007 Dec. 28; 364(4):985-989. PMID: 17971292.
25. Hall. A commotion in the blood: life, death, and the immune system. London: Little, Brown 1998; 1997.
26. Hasegawa et al. Activation of a consensus FNR-dependent promoter by DNR of *Pseudomonas aeruginosa* in response to nitrite. FEMS Microbiol Lett. 1998 Sep. 15; 166(2):213-217. PMID: 9770276.
27. Hoeren et al. Sequence and expression of the gene encoding the respiratory nitrous-oxide reductase from *Paracoccus denitrificans*. Eur J Biochem. 1993 Nov. 15; 218(1):49-57. PMID: 8243476.

28. Huang et al. A novel conditionally replicative adenovirus vector targeting telomerase-positive tumour cells. Clin Cancer Res 2004; 10(4): 1439-1445. PMID: 14977847.
29. Isabella et al. Deep sequencing-based analysis of the anaerobic stimulon in *Neisseria gonorrhoeae*. BMC Genomics. 2011 Jan. 20; 12:51. PMID: 21251255.
30. Jain et al. Can engineered bacteria help control cancer? Proc Natl Acad Sci USA. 2001 Dec. 18; 98(26):14748-50. PMID: 11752416.
31. Kinter et al. The common gamma-chain cytokines IL-2, IL-7, IL-15, and IL-21 induce the expression of programmed death-1 and its ligands. J Immunol. 2008 Nov. 15; 181(10):6738-6746. PMID: 18981091.
32. Liu et al. Tumor-targeting bacterial therapy: A potential treatment for oral cancer (Review). Oncol Lett. 2014 December; 8(6):2359-2366. PMID: 25364397.
33. Mead et al. Exocytosis of CTLA-4 is dependent on phospholipase D and ADP ribosylation factor-1 and stimulated during activation of regulatory T cells. J Immunol. 2005 Apr. 15; 174(8):4803-4811. PMID: 15814706.
34. Moore et al. Regulation of FNR dimerization by subunit charge repulsion. J Biol Chem. 2006 Nov. 3; 281(44): 33268-33275. PMID: 16959764.
35. Morrissey et al. Tumour targeting with systemically administered bacteria. Curr Gene Ther. 2010 February; 10(1):3-14.
36. Nauts et al. Coley toxins—the first century. Adv Exp Med Biol 1990; 267: 483-500. PMID: 2088067.
37. Nougayrede et al. *Escherichia coli* induces DNA double-strand breaks in eukaryotic cells. Science. 2006 Aug. 11; 313(5788):848-851. PMID: 16902142.
38. Nuno B, Chakrabarty A M, Fialho A M. Engineering of bacterial strains and their products for cancer therapy. Appl Microbiol Biotechnol. 2013 June; 97(12):5189-5199. PMID: 23644748.
39. Olier et al. Genotoxicity of *Escherichia coli* Nissle 1917 strain cannot be dissociated from its probiotic activity. Gut Microbes. 2012 November-December; 3(6):501-509. PMID: 22895085.
40. Patyar et al. Bacteria in cancer therapy: a novel experimental strategy. J Biomed Sci. 2010 Mar. 23; 17(1):21. PMID: 20331869.
41. Peggs et al. Blockade of CTLA-4 on both effector and regulatory T cell compartments contributes to the antitumor activity of anti-CTLA-4 antibodies. J Exp Med. 2009 Aug. 3; 206(8):1717-1725. PMID: 19581407.
42. Perkins et al. Regulation of CTLA-4 expression during T cell activation. J Immunol. 1996 Jun. 1; 156(11):4154-4159. PMID: 8666782.
43. Rajani et al. Harnessing the power of onco-immunotherapy with checkpoint inhibitors. Viruses. 2015 Nov. 13; 7(11):5889-5901. PMID: 26580645.
44. Ray et al. The effects of mutation of the anr gene on the aerobic respiratory chain of *Pseudomonas aeruginosa*. FEMS Microbiol Lett. 1997 Nov. 15; 156(2):227-232. PMID: 9513270.
45. Reister et al. Complete genome sequence of the Gram-negative probiotic *Escherichia coli* strain Nissle 1917. J Biotechnol. 2014 Oct. 10; 187:106-107. PMID: 25093936.
46. Rembacken et al. Non-pathogenic *Escherichia coli* versus mesalazine for the treatment of ulcerative colitis: a randomised trial. Lancet. 1999 Aug. 21; 354(9179):635-639. PMID: 10466665.
47. Remington's Pharmaceutical Sciences, 22$^{nd}$ ed. Mack Publishing Co. Easton, Pa.
48. Riley et al. Modulation of TCR-induced transcriptional profiles by ligation of CD28, ICOS, and CTLA-4 receptors. Proc Natl Acad Sci USA. 2002 Sep. 3; 99(18):11790-11795. PMID: 12195015.
49. Salmon et al. Global gene expression profiling in *Escherichia coli* K12. The effects of oxygen availability and FNR. J Biol Chem. 2003 Aug. 8; 278(32):29837-29855. PMID: 12754220.
50. Sat et al. The *Escherichia coli* mazEF suicide module mediates thymineless death. J Bacteriol. 2003 March; 185(6):1803-1807. PMID: 12618443.
51. Sawers. Identification and molecular characterization of a transcriptional regulator from *Pseudomonas aeruginosa* PAO1 exhibiting structural and functional similarity to the FNR protein of *Escherichia coli*. Mol Microbiol. 1991 June; 5(6):1469-1481. PMID: 1787797.
52. Schultz. Clinical use of *E. coli* Nissle 1917 in inflammatory bowel disease. Inflamm Bowel Dis. 2008 July; 14(7):1012-1018. PMID: 18240278.
53. Śledzińska et al. Negative immune checkpoints on T lymphocytes and their relevance to cancer immunotherapy. Mol Oncol. 2015 December; 9(10):1936-1965. PMID: 26578451.
54. Sonnenborn et al. The non-pathogenic *Escherichia coli* strain Nissle 1917—features of a versatile probiotic. Microbial Ecology in Health and Disease. 2009; 21:122-158.
55. Teicher. Physiologic mechanisms of therapeutic resistance. Blood flow and hypoxia. Hematol Oncol Clin North Am. 1995 April; 9(2):475-506. PMID: 7642474.
56. Theys et al. Repeated cycles of *Clostridium*-directed enzyme prodrug therapy result in sustained antitumour effects in vivo. Br J Cancer. 2006 Nov. 6; 95(9):1212-9. PMID: 17024128.
57. Trunk et al. Anaerobic adaptation in *Pseudomonas aeruginosa*: definition of the ANR and DNR regulons. Environ Microbiol. 2010 June; 12(6):1719-1733. PMID: 20553552.
58. Ukena et al. Probiotic *Escherichia coli* Nissle 1917 inhibits leaky gut by enhancing mucosal integrity. PLoS One. 2007 Dec. 12; 2(12):e1308. PMID: 18074031.
59. Unden et al. Alternative respiratory pathways of *Escherichia coli*: energetics and transcriptional regulation in response to electron acceptors. Biochim Biophys Acta. 1997 Jul. 4; 1320(3):217-234. PMID: 9230919.
60. Vaupel et al. Oxygenation status of human tumours: reappraisal using computerized pO2 histography. In: Vaupel P W, Ed. Tumour Oxygenation. Germany: Gustav Fischer Verlag, 1995; 219-232.
61. Wachsberger et al. Tumor response to ionizing radiation combined with antiangiogenesis or vascular targeting agents: exploring mechanisms of interaction. Clin Cancer Res. 2003 June; 9(6):1957-1971. PMID: 12796357.
62. Walunas et al. CTLA-4 can function as a negative regulator of T cell activation. Immunity. 1994 August; 1(5):405-413. PMID: 7882171.
63. Winteler et al. The homologous regulators ANR of *Pseudomonas aeruginosa* and FNR of *Escherichia coli* have overlapping but distinct specificities for anaerobically inducible promoters. Microbiology. 1996 March; 142(Pt 3):685-693. PMID: 8868444.
64. Wright et al. GeneGuard: A modular plasmid system designed for biosafety. ACS Synth Biol. 2015 Mar. 20; 4(3):307-316. PMID: 24847673.

65. Wu et al. Direct regulation of the natural competence regulator gene tfoX by cyclic AMP (cAMP) and cAMP receptor protein in Vibrios. Sci Rep. 2015 Oct. 7; 5:14921. PMID: 26442598.
66. Zhang et al. Escherichia coli Nissle 1917 targets and restrains mouse B16 melanoma and 4 T1 breast tumor through the expression of azurin protein. Appl Environ Microbiol. 2012 November; 78(21):7603-7610. PMID: 22923405.
67. Zimmermann et al. Anaerobic growth and cyanide synthesis of Pseudomonas aeruginosa depend on ANR, a regulatory gene homologous with FNR of Escherichia coli. Mol Microbiol. 1991 June; 5(6):1483-1490. PMID: 1787798.
68. Cancer Therapy Vol 6, 545-552, 2008 "Techniques for intratumoral chemotherapy of lung cancer by bronchoscopic drug delivery" Firuz Celikoglu, Seyhan I Celikoglu, Eugene P Goldberg
69. J Vasc Interv Radiol. 2010 October; 21(10):1533-8. Single-session percutaneous ethanol ablation of early-stage hepatocellular carcinoma with a multipronged injection needle: results of a pilot clinical study. Lencioni R, Crocetti L, Cioni D, Pina C D, Oliveri F, De Simone P, Brunetto M, Fi
70. Therap Adv Gastroenterol. 2008 September; 1(2): 103-109. Endoscopic Ultrasound-Guided Fine Needle Injection for Cancer Therapy: The Evolving Role of Therapeutic Endoscopic Ultrasound. Elizabeth C. Verna and Vasudha Dha
71. Mol Clin Oncol. 2013 March-April; 1(2): 231-234. Local drug delivery to a human pancreatic tumor via a newly designed multiple injectable needle. Koji Ohara, Masayuki Kohno, Tomohisa Horibe, and Koji Kawakami
72. Gastroenterol Res Pract. 2013; 2013: 207129. Therapeutic Endoscopic Ultrasonography: Intratumoral Injection for Pancreatic Adenocarcinoma. Lawrence A. Shirley, Laura K. Aguilar, Estuardo Aguilar-Cordova, Mark Bloomston, and Jon P. Walker
73. Lambin P, Theys J, Landuyt W, Rijken P, van der Kogel A, van der Schueren E, Hodgkiss R, Fowler J, Nuyts S, de Bruijn E, Van Mellaert L, Anne J. Colonisation of Clostridium in the body is restricted to hypoxic and necrotic areas of tumours. Anaerobe. 1998; 4:183-188.
74. Oncotarget. 2015 Mar. 20; 6(8): 5536-5546. Clostridium novyi-NT can cause regression of orthotopically implanted glioblastomas in rats. Verena Staedtke, Ren-Yuan Bai, Weiyun Sun, Judy Huang, Kathleen Kazuko Kibler, Betty M. Tyler, Gary L. Gallia, Kenneth Kinzler, Bert Vogelstein, Shibin Zhou, and Gregory J. Riggins
75. Cancer Immun. 2013; 13:5. Epub 2013 Jan. 22. CTLA-4 blockade in tumor models: an overview of preclinical and translational research. Joseph F. Grosso and Maria N. Jure-Kunkel
76. Gilson Baia, David Vasquez-Dunddel, Daniel Ciznadija, David Sidransky, Amanda Katz, Keren Paz, A humanized mouse model for translational assessment of targeted immune checkpoint blockade. [abstract]. In: Proceedings of the 106th Annual Meeting of the American Association for Cancer Research; 2015 Apr. 18-22; Philadelphia, Pa. Philadelphia (Pa.): AACR; Cancer Res 2015; 75(15 Suppl): Abstract nr 5031. doi:10.1158/1538-7445.AM2015-5031
77. Stritzker J, Weibel S, Hill P J, Oelschlaeger T A, Goebel W, Szalay A A. Tumor-specific colonization, tissue distribution, and gene induction by probiotic Escherichia coli Nissle 1917 in live mice. Int J Med Microbiol 2007; 297:51 A 62.
78. Pedersen A E, Buus S, Claesson M H Treatment of transplanted CT26 tumour with dendritic cell vaccine in combination with blockade of vascular endothelial growth factor receptor 2 and CTLA-4. Cancer Lett 235: 229-238
79. Curr Protoc Immunol. 2008 May; CHAPTER: Unit-15.21.Creation of "Humanized" Mice to Study Human Immunity. Todd Pearson, 1 Dale L. Greiner, 2 and Leonard D. Shultz
80. Heap et al., 2014. Oncotarget, Vol. 5, No. 7. Spores of Clostridium engineered for clinical efficacy and safety cause regression and cure of tumors in vivo.
81. Roberts et al., Sci Transl Med. 2014 Aug. 13; 6(249): 249ra111. Intratumoral injection of Clostridium novyi-NT spores induces antitumor responses
82. J Immunol. 2014 Jul. 15; 193(2):587-96. doi: 10.4049/jimmunol.1302455. Epub 2014 Jun. 18. Humanized mice as a model for aberrant responses in human T cell immunotherapy. Vudattu N K, Waldron-Lynch F, Truman L A, Deng S, Preston-Hurlburt P, Torres R, Raycroft M T, Mamula M J, Herold K C.

EXAMPLES

The following examples provide illustrative embodiments of the disclosure. One of ordinary skill in the art will recognize the numerous modifications and variations that may be performed without altering the spirit or scope of the disclosure. Such modifications and variations are encompassed within the scope of the disclosure. The Examples do not in any way limit the disclosure.

The disclosure provides herein a sequence having at least about 80%, at least about 85%, at least about 90%, at least about 95%, or at least about 99% homologous to the sequence any of the SEQ ID NOs described in the Examples, below.

Example 1. Anti-Cancer Molecules

Exemplary nucleic acid sequences for use in constructing single-chain anti-CTLA-4 antibodies are described in International Patent Application PCT/US2017/013072, filed Jan. 11, 2017, published as WO2017/123675, the contents of which is herein incorporated by reference in its entirety, for example in Example 1. In some embodiments, genetically engineered bacteria comprise a nucleic acid sequence that is at least about 80%, at least about 85%, at least about 90%, at least about 95%, or at least about 99% homologous to the DNA sequence or comprises a DNA sequence that encodes a polypeptide that is at least about 80%, at least about 85%, at least about 90%, at least about 95%, or at least about 99% homologous to SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, and/or SEQ ID NO: 776. In another embodiment, the genetically engineered bacteria comprise a gene sequence encoding a polypeptide comprising a sequence selected from SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, and/or SEQ ID NO: 776. In yet another embodiment, the polypeptide expressed by the genetically engineered bacteria consists of a sequence selected from SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, and/or SEQ ID NO: 776.

In some embodiments, genetically engineered bacteria comprise a nucleic acid sequence that is at least about 80%, at least about 85%, at least about 90%, at least about 95%, or at least about 99% homologous to the DNA sequence or comprises a DNA sequence that encodes a polypeptide that is at least about 80%, at least about 85%, at least about 90%, at least about 95%, or at least about 99% homologous to SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, and/or SEQ ID NO: 788. In another embodiment, the gene sequence comprises a sequence selected from SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, and/or SEQ ID NO: 788. In another embodiment, the gene sequences consists of a sequence selected from SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, and/or SEQ ID NO: 788.

Example 2. Tumor Pharmacokinetics for *E coli* Nissle

Tumor pharmacokinetics were assayed and determined as described in are described in International Patent Application PCT/US2017/013072, filed Jan. 11, 2017, published as WO2017/123675, the contents of which is herein incorporated by reference in its entirety, e.g., Example 58-61. Tumor pharmacokinetics of Nissle (1e7 and 1e8 cells/dose) were determined using a CT26 tumor model over 7 days. Bacterial counts in the tumor tissue were similar at both doses. No bacteria were detected in blood at any of the time points.

Tumor pharmacokinetics of streptomycin resistant Nissle and a Nissle DOM mutant (Nissle delta PAL::CmR) were compared in a CT26 tumor model. Bacterial counts in the tumor tissue were similar in both strains. No bacteria were detected in the blood. These results indicate that both the wild type and the DOM mutant Nissle can survive in the tumor environment.

Cytokine response in vivo to intratumoral administration of streptomycin resistant Nissle was assessed using a CT26 tumor model at either 1e6 (Group1) or 1e7 cells/dose (Group 2). Levels measured in serum and in the tumor over the time course post SYN94 intratumoral administration in the mouse CT-24 model at the indicated doses. Results indicate that a cytokine response is elicited in the tumor at the higher dose but not in the serum. The lower dose does not elicit a substantial cytokine response.

Tumoral PK, levels of bacteria in various tissues and cytokine levels in these tissues were assessed post IT dosing (1e7 cells/dose) at 48 hours. As seen in Internationals Patent Application PCT/US2017/013072, incorporated herein by reference, bacteria were predominantly present in the tumor and absent in other tissues tested. TNFalpha levels measured were similar in all serum, tumor and liver between SYN94, Saline treated and naïve groups. TNFalpha levels are negligible relative to TNFalpha levels measured at 1.5 hours when Nissle is administered at 1e8 via IV. However, even with IV administration, TNFalpha levels drop off to undetectable levels at 4 hours. Similar low levels of TNFalpha are detected at a 1e6 IV dose of SYN94.

Example 3A. LC-MS/MS Quantification of Metabolites

Quantification of adenosine, kynurenine, tryptophan and arginine in bacterial supernatants and in tumor tissues was performed by LC-MS/MS as described in International Patent Application PCT/US2017/013072, filed Jan. 11, 2017, published as WO2017/123675, the contents of which is herein incorporated by reference in its entirety.

Example 3B. Engineering Bacterial Strains Using Chromosomal Insertions

Methods for the integration of constructs into the *E. coli* Nissle genome are described in Internationals Patent Application PCT/US2017/013072, incorporated herein by reference.

Example 4. Generation of Adenosine Degrading Strains

Figure 4:
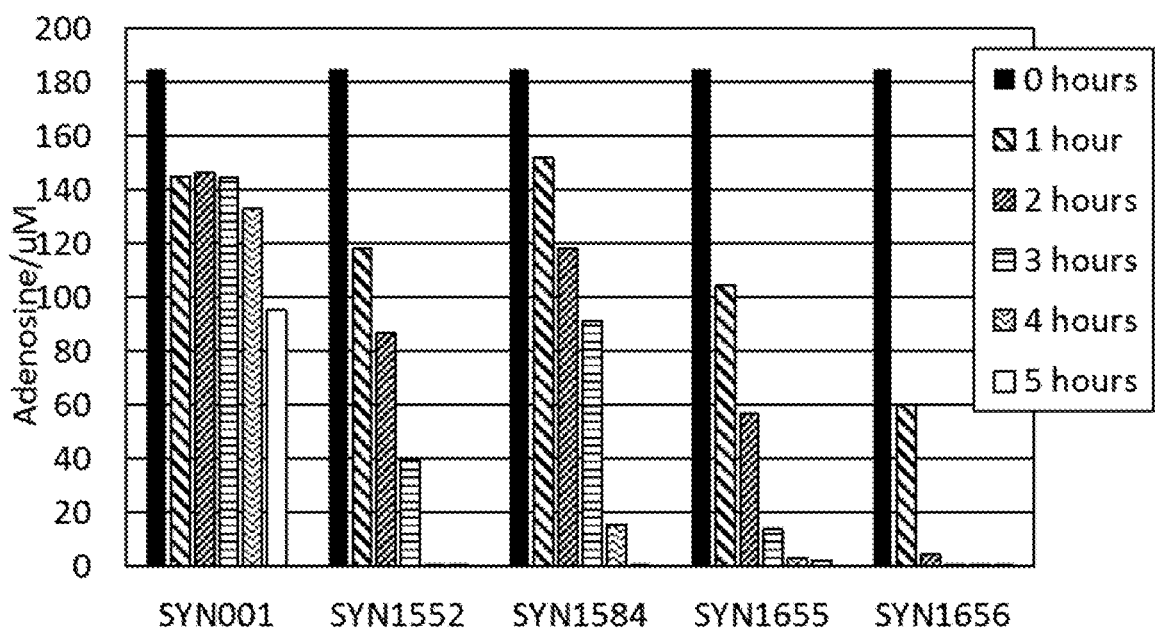
FIG. 4 depicts a bar graph showing adenosine degradation at substrate limiting conditions, in the presence of 1 uM adenosine, which corresponds to adenosine levels expected in the in vivo tumor environment. The results show that a low concentration of activated SYN1656 ($1 \times 10^6$ cells), (and also other strains depicted), are capable of degrading adenosine below the limit of quantitation.

A schematic representation of the 3 operons in the adenosine degradation pathway is shown in FIGS. 4A and 4B. To generate Adenosine consuming strains, each one of the operons (or single gene in the case of nupC) were cloned into a KIKO vector under the control of the $P_{fnrS}$ promoter. Knock-in PCR products were made from the KIKO vectors and allelic exchange was performed to integrate these operons into *E. coli* genome. Allelic exchange was facilitated through use of the lambda red recombinase system as described herein. Multiple strain combinations were generated and Table 21. summarizes the strains generated and compared in adenosine degradation assays. Table 22. summarizes the integration sites that were used for each of the constructs.

TABLE 21

Adenosine consuming strains

| Strain: | Genotype |
|---|---|
| SYN01 | WT |
| SYN1565 | $P_{fnrS}$-nupC |
| SYN1584 | $P_{fnrS}$-nupC; $P_{fnrS}$-xdhABC |
| SYN1655 | $P_{fnrS}$-nupC; $P_{fnrS}$-add-xapA-deoD |
| SYN1656 | $P_{fnrS}$-nupC; $P_{fnrS}$-xdhABC; $P_{fnrS}$-add-xapA-deoD |

TABLE 22

Integration sites (can also see strain table)

| Construct | Chromosomal Integration Site |
|---|---|
| $P_{fnrS}$-nupC | integrated into HA1/2 (agaI/rsmI) region |
| $P_{fnrS}$-xdhABC | integrated into HA9/10 (exo/cea) region |
| $P_{fnrS}$-add-xapA-deoD | integrated into malE/K region |

Example 5. In Vitro Adenosine Degradation Measurements

In Vitro Adenosine Consumption

Glucose is the preferred carbon source of *E. coli*. However, *E. coli* can also use adenosine as a sole source of carbon in the absence of glucose. To assess the ability of the newly generated strains to degrade adenosine, and if able to do so even in the presence of the preferred carbon source, glucose.

To accomplish this, overnight cultures of each strain including a wild type control were grown in LB at 37 C, shaking at 250 rpm. Cultures were back diluted 1:100 (10 mL in 125 mL baffled flask) and grown for 1.5 hours to early log phase. Once cultures reached early log, cultures were moved into a Coy anaerobic chamber supplying an anaerobic atmosphere (85% N2, 10% $CO_2$, 5% H2). Cultures were incubated anaerobically for 4 hours to allow for induction of the engineered adenosine degradation pathway gene(s).

Cultures were removed from the anaerobic chamber and tested for adenosine degradation activity. To accomplish this, ~1e8 activated bacterial cells were spun down in 1.5 mL microcentrifuge tubes and resuspended in adenosine assay buffer (1×M9 minimal media containing 10 mM adenosine that either contained no glucose or 0.5% glucose (see slide)). Tubes were incubated statically at 37 degrees Celsius for 5h, and supernatant samples were removed every hour for 5h. Supernatant samples were analyzed via LC-MS for determination of adenosine concentration.

Figure 3:
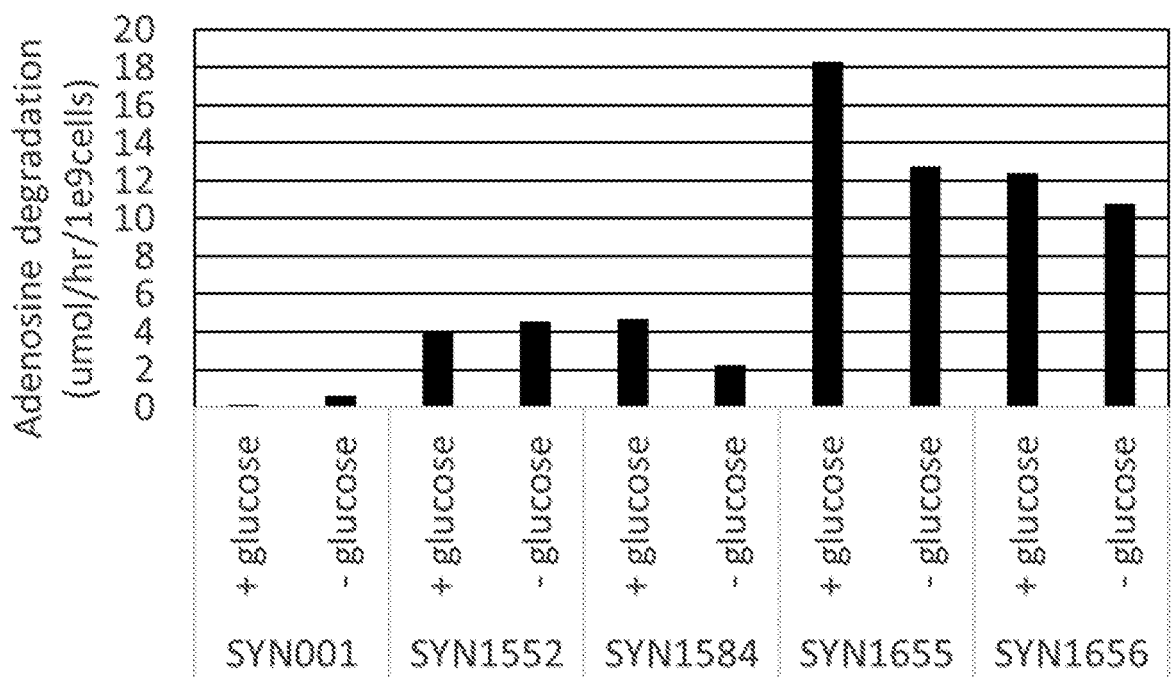
FIG. 3 depicts a bar graph showing that strains SYN1565 (comprising PfnrS-nupC), SYN1584 (comprising PfnrS-nupC; PfnrS-xdhABC) SYN1655 (comprising PfnrS-nupC; PfnrS-add-xapA-deoD) and SYN1656 (comprising PfnrS-nupC; PfnrS-xdhABC; PfnrS-add-xapA-deoD) can degrade adenosine in vitro, even when glucose is present.

Results are show in FIG. 3. and indicate that all engineered strains were able to degrade adenosine (determined by its absence in the supernatant samples) at a rate higher than that of the wild type control strain. All strains were able to degrade adenosine regardless whether E. coli's preferred carbon source, glucose, was present.

In Vitro Activity Under Substrate Limited Conditions

In the previous study, substrate was not limiting, i.e., strains were able to function at $V_{max}$. Such substrate concentrations were far in excess of concentrations expected in vivo. Next, adenosine degradation ability of the engineered bacteria was assessed at more limiting substrate concentrations (more consistent with adenosine concentrations in a tumor in vivo), and at lower doses (more consistent with doses which can be administered IV or IT in a mouse without causing sepsis).

Overnight cultures of each strain were grown in LB at 37 C, shaking at 250 rpm. Cultures were back diluted 1:100 (10 mL in 125 mL baffled flask) and grown for 1.5 hours to early log phase. Once cultures reached early log, they were moved into a Coy anaerobic chamber supplying an anaerobic atmosphere (85% N2, 10% $CO_2$, 5% H2). Cultures were incubated anaerobically for 4 hours to allow for induction of the engineered adenosine degradation pathway gene(s).

Activated cells were quantitated on a cellometer and diluted in PBS to 5e8 cfu/mL. 10 uL of this suspension (comprising 5e6 bacteria) were resuspended in 1 mL of adenosine assay buffer comprised of M9 minimal media, 0.5% glucose, and 100 uM adenosine. Cells were incubated statically at 37 C. Supernatant samples were removed every hour for 5 hours to determine rates of adenosine degradation. Supernatant samples were analyzed via LC-MS for determination of adenosine concentration. Rates of degradation reported are the maximal linear rates between 0 to 5 hours of sampling (this may not include the later time points as rates may not be linear at extremely low substrate (adenosine) degradation).

Figure 5:
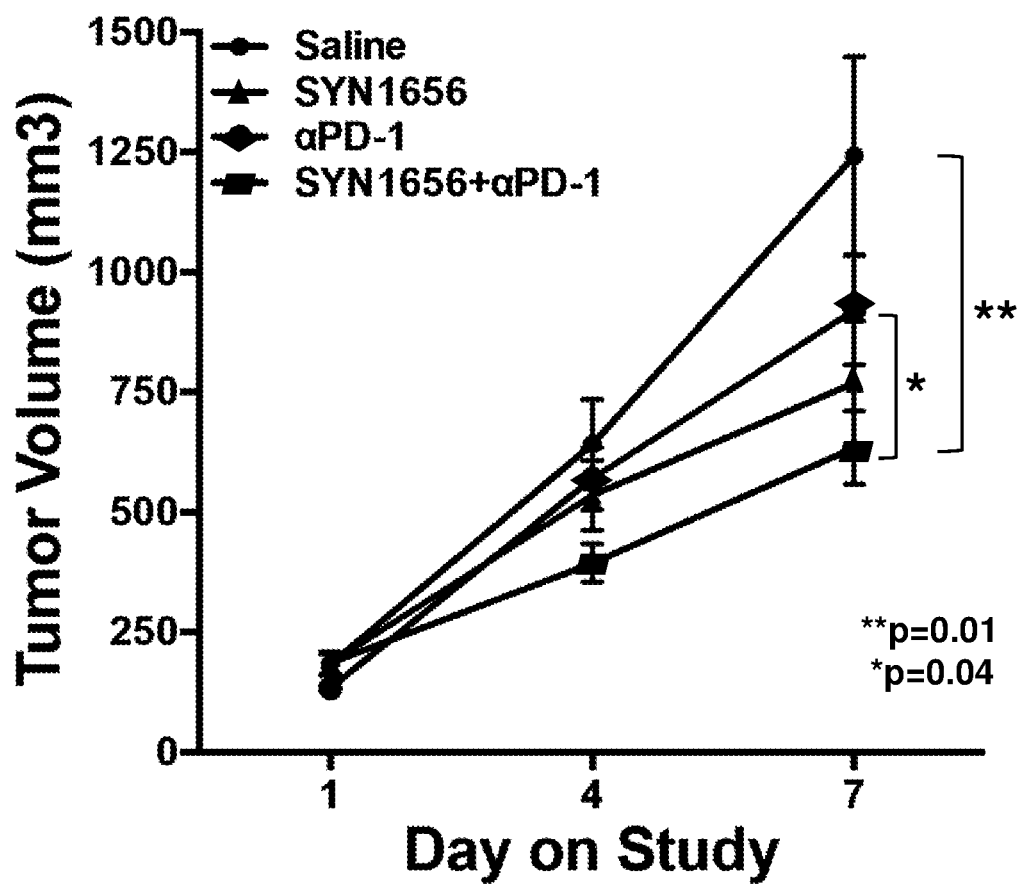
FIG. 5 depicts a line graph of an in vivo analysis of the effect of adenosine consumption by engineered *E. coli* Nissle (SYN1656), alone or in combination with anti-PD1, on tumor volume. The data suggest anti-tumor activity of adenosine-consuming strain as single agent and in combination with aPD-1.

Results are shown in FIGS. 5 and 6 and indicate that all engineered strains were able to degrade adenosine (determined by its absence in the supernatant samples) at a rate higher than that of control strain SYN01. SYN1656, the most highly engineered strain containing all three integrations comprising the adenosine degradation pathway, was able to degrade adenosine at the highest rate and to take adenosine levels to undetectable levels by 3 hours.

The linear rate is shown in Table 23.

TABLE 23

Linear Adenosine Degradation Rates

| | Linear Rate (umol/hr/$10^9$ cells) |
|---|---|
| SYN001 | 1.95 |
| SYN1552 | 5.90 |
| SYN1584 | 6.39 |
| SYN1655 | 5.65 |
| SYN1656 | 6.88 |

Example 6. Effect of Adenosine Consuming Strains In Vivo

The effects of an adenosine consuming strain SYN1656 (comprising $P_{fnrS}$-nupC; $P_{fnrS}$-xdhABC; $P_{fnrS}$-add-xapA-deoD) in vivo was assessed, alone and in combination with anti-PD1.

CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

To prepare the cells, streptomycin resistant Nissle (SYN094) was grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice. To prepare the SYN1656, cells were diluted 1:100 in LB (2 L), grown for 1.5 h aerobically, then shifted to the anaerobe chamber for 4 hours. Prior to administration, cells were concentrated 200× and frozen (15% glycerol, 2 g/L glucose, in PBS).

Approximately 10 days after CT 26 implantation, on day 1, bacteria were suspended in 0.1 ml of PBS and mice were weighed, measured, and randomized into treatment groups as follows: Group 1 saline injection (100 ul) (n=14); Group 2 SYN94 IT 10e7 (n=14); Group 3-SYN1656 IT 10e7 (n=14); Group 4-SYN1656 IT 10e7 plus aPD-1 (BioXcell), 10 mg/kg, i.p. (n=14); Group 5-aPD-1 (BioXcell), 10 mg/kg, i.p (n=9).

On day 1 and day 4, animals were dosed according to their grouping either with saline or with the strains intratumorally (IT) alone or in combination with anti-PD1 (I.P). Plasma and were collected for further analysis. FIG. 5 shows the tumor volume of the mice from day 1, 4, and 7. Results show that the tumor volume is decreased in all three treatment groups (SYN1656, anti-PD1, and SYN1656 plus anti-PD1) as compared to the saline treated controls at 7 days; tumor size is smallest in the SYN1656 and anti-PD1 treated group, followed by SYN1656 alone and anti-PD1 alone, indicating that there may be a synergistic effect between the two treatments, and suggesting anti-tumor activity of adenosine-consuming strain as single agent and in combination with aPD-1. Tumor volume was significantly lower in the animals treated with SYN1656 and anti-PD1 than with saline alone (p=0.01). Tumor volume of animals treated with SYN1656 and anti-PD1 was also significantly lower than animals treated with anti-PD1 alone.

In other studies, this study is extended to include dosing and analysis at days 10, 15, and 18, until animals reach a tumor size of approximately 2000 mm³.

Example 7. Synthesis of Constructs for Tryptophan Biosynthesis

Various constructs are synthesized, and cloned into vector pBR322 for transformation of *E. coli*. In some embodiments, the constructs encoding the effector molecules are integrated into the genome. Non-limiting examples of tryptophan production construct sequences include fbrAroG (with RBS and leader region; SEQ ID NO: 868), fbrAroG (SEQ ID NO: 862), fbrAroG-serA (with RBS; SerA starts after second RBSSEQ ID NO: 863), SerA (with RBSSEQ ID NO: 864), TrpEDCBA (with RBS and leader region SEQ ID NO: 872), fbrS40FTrpE-DCBA (with leader region and RBSSEQ ID NO: 878), fbrTrpE(SEQ ID NO: 879) In some embodiments, the Tryptophan Production Construct is at least about 80%, at least about 85%, at least about 90%, at least about 95%, or at least about 99% homologous to the sequence of SEQ ID NO: 862, SEQ ID NO: 863, SEQ ID NO: 864, SEQ ID NO: 872, SEQ ID NO: 873, SEQ ID NO: 868, SEQ ID NO: 878, SEQ ID NO: 879.

Example 8. Tryptophan Production in an Engineered Strain of *E. coli* Nissle

A number of tryptophan metabolites, either host-derived (such as tryptamine or kynurenine) or intestinal bacteria-derived (such as indoleacetate or indole), have been shown to downregulate inflammation in the context of IBD, via the activation of the AhR receptor. Other tryptophan metabolites, such as the bacteria-derived indole propionate, have been shown to help restore intestinal barrier integrity, in experimental models of colitis. In this example, the *E. coli* strain Nissle was engineered to produce tryptophan, the precursor to all those beneficial metabolites.

First, in order to remove the negative regulation of tryptophan biosynthetic genes mediated by the transcription factor TrpR, the trpR gene was deleted form the *E. coli* Nissle genome. The tryptophan operon trpEDCBA was amplified by PCR from the *E. coli* Nissle genomic DNA and cloned in the low-copy plasmid pSC101 under the control of the tet promoter, downstream of the tetR repressor gene. This tet-trpEDCBA plasmid was then transformed into the ΔtrpR mutant to obtain the ΔtrpR, tet-trpEDCBA strain. Subsequently, a feedback resistant version of the aroG gene (aroG$^{fbr}$) from *E. coli* Nissle, coding for the enzyme catalyzing the first committing step towards aromatic amino acid production, was synthetized and cloned into the medium copy plasmid p15A, under the control of the tet promoter, downstream of the tetR repressor. This plasmid was transformed into the ΔtrpR, tet-trpEDCBA strain to obtain the ΔtrpR, tet-trpEDCBA, tet-aroG$^{fbr}$ strain. Finally, a feedback resistant version of the tet-trpEBCDA construct (tet-trpE$^{fbr}$BCDA) was generated from the tet-trpEBCDA. Both the tet-aroG$^{fbr}$ and the tet-trpE$^{fbr}$BCDA constructs were transformed into the ΔtrpR mutant to obtain the ΔtrpR, tet-trpE$^{fbr}$DCBA, tet-aroG$^{fbr}$ strain.

Figure 6A:
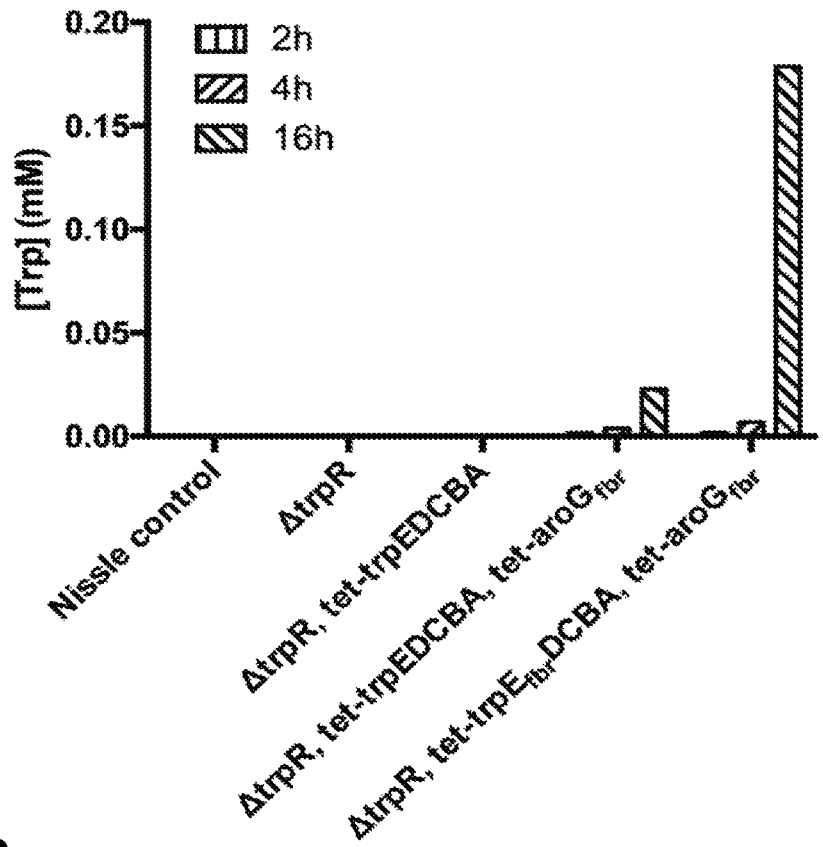
FIG. 6A, FIG. 6B, FIG. 6C, and FIG. 6D depict bar graphs showing tryptophan production by various engineered bacterial strains.

All generated strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 0.5% glucose and placed at 37 C at 250 rpm. 200 uL were collected at 2h, 4h and 16h and tryptophan was quantified by LC-MS/MS in the bacterial supernatant. FIG. 6A shows that tryptophan is being produced and secreted by the ΔtrpR, tet-trpEDCBA, tet-aroG$^{fbr}$ strain. The production of tryptophan is significantly enhanced by expressing the feedback resistant version of trpE.

Figure 6B:
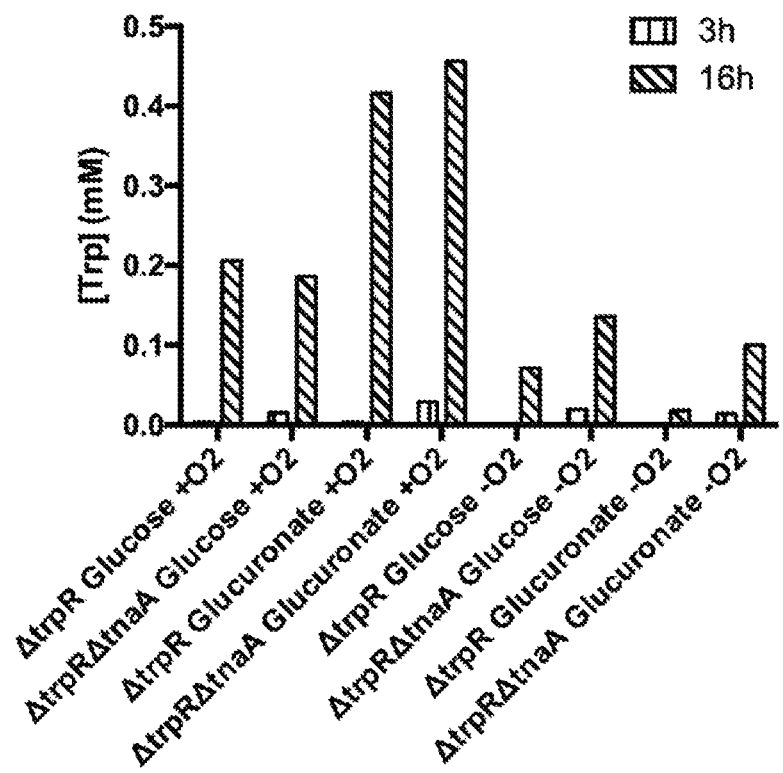

Example 9. Improved Tryptophan by Using a Non-PTS Carbon Source and by Deleting the tnaA Gene Encoding for the Tryptophanase Enzyme Converting Tryptophan into Indole One of the precursor molecule to tryptophan in *E. coli* is phosphoenolpyruvate (PEP). Only 3% of available PEP is normally used to produce aromatic acids (that include tryptophan, phenylalanine and tyrosine). When *E. coli* is grown using glucose as a sole carbon source, 50% of PEP is used to import glucose into the cell using the phosphotransferase system (PTS). In order to increase tryptophan production, a non-PTS oxidized sugar, glucuronate, was used to test tryptophan secretion by the engineered *E. coli* Nissle strain ΔtrpR, tet-trpE$^{fbr}$DCBA, tet-aroG$^{fbr}$. In addition, the tnaA gene, encoding the tryptophanase enzyme, was deleted in the ΔtrpR, tet-trpE$^{fbr}$DCBA, tet-aroG$^{fbr}$ strain in order to block the conversion of tryptophan into indole to obtain the ΔtrpRΔtnaA, tet-trpE$^{fbr}$DCBA, tet-aroG$^{fbr}$ strain.

the ΔtrpR, tet-trpE$^{fbr}$DCBA, tet-aroG$^{fbr}$ and ΔtrpRΔtnaA, tet-trpE$^{fbr}$DCBA, tet-aroG$^{fbr}$ strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucose or 1% glucuronate and placed at 37 C at 250 rpm or at 37 C in an anaerobic chamber. 200 uL were collected at 3h and 16h and tryptophan was quantified by LC-MS/MS in the bacterial supernatant. FIG. 6B shows that tryptophan production is doubled in aerobic condition when the non-PTS oxidized sugar glucoronate was used. In addition, the deletion of tnaA had a positive effect on tryptophan production at the 3h time point in both aerobic and anaerobic conditions and at the 16h time point, only in anaerobic condition.

Figure 6C:
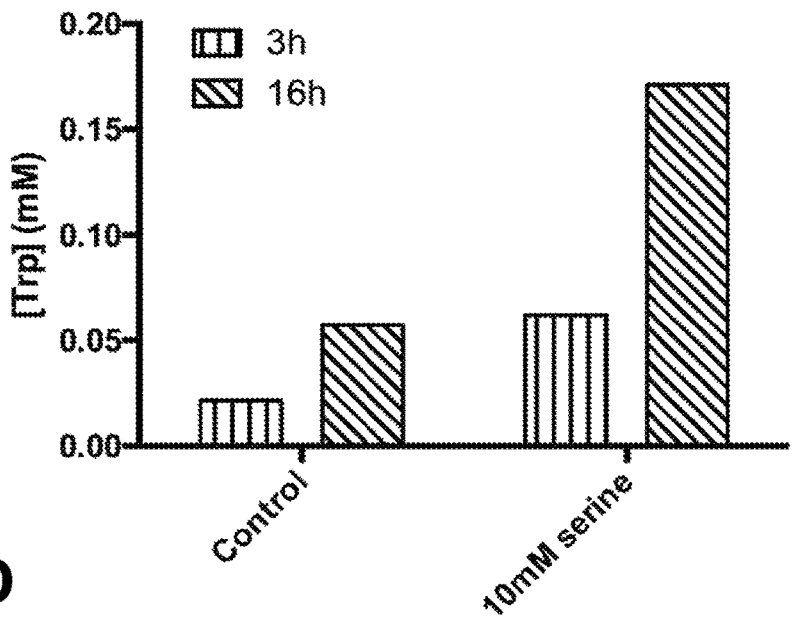

Example 10. Improved Tryptophan Production by Through Increase of Serine Biosynthesis The last step in the tryptophan biosynthesis in *E. coli* consumes one molecule of serine. In this example, we demonstrate that serine availability is a limiting factor for tryptophan production and describe the construction of the tryptophan producing *E. coli* Nissle strains ΔtrpRΔtnaA, tet-trpE$^{fbr}$DCBA, tet-aroG$^{fbr}$serA and ΔtrpRΔtnaA, tet-trpE$^{fbr}$DCBA, tet-aroG$^{fbr}$serA$^{fbr}$ strains.

the ΔtrpRΔtnaA, tet-trpE$^{fbr}$DCBA, tet-aroG$^{fbr}$ strain was grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucuronate or 1% glucuronate and 10 mM serine and placed at 37 C an anaerobic chamber. 200 uL were collected at 3h and 16h and tryptophan was quantified by LC-MS/MS in the bacterial supernatant. FIG. 6C shows that tryptophan production is improved three fold by serine addition.

In order to increase the rate of serine biosynthesis in the ΔtrpRΔtnaA, tet-trpE$^{fbr}$DCBA, tet-aroG$^{fbr}$ strain, the serA gene from E. coli Nissle encoding the enzyme catalyzing the first step in the serine biosynthetic pathway was amplified by PCR and cloned into the tet-aroG$^{fbr}$ plasmid by Gibson assembly. The newly generated tet-aroG$^{fbr}$-serA construct was then transformed into a ΔtrpRΔtnaA, tet-trpE$^{fbr}$DCBA strain to generate the ΔtrpRΔtnaA, tet-trpE$^{fbr}$DCBA, tet-aroG$^{fbr}$-serA strain. The tet-aroG$^{fbr}$-serA construct was further modified to encode a feedback resistant version of serA (serA$^{fbr}$). The newly generated tet-aroG$^{fbr}$-serA$^{fbr}$ construct was used to produce the ΔtrpRΔtnaA, tet-trpE$^{fbr}$DCBA, tet-aroG$^{fbr}$-serA$^{fbr}$ strain, optimized to improve the rate of serine biosynthesis and maximize tryptophan production.

Example 11. Comparison of Various Tryptophan Producing Strains

Compare the rates of tryptophan production in the different strains generated, the following constructs and strains were generated according to methods and sequences described herein, and assayed for tryptophan production in the presence of glucuronate as a carbon source under aerobic conditions. SYN2126 comprises ΔtrpRΔtnaA (ΔtrpRΔtnaA). SYN2323 comprises ΔtrpRΔtnaA and a tetracycline inducible construct for the expression of feedback resistant aroG on a plasmid (ΔtrpRΔtnaA, tet-aroGfbr). SYN2339 comprises ΔtrpRΔtnaA and a first tetracycline inducible construct for the expression of feedback resistant aroG on a first plasmid and a second tetracycline inducible construct with the genes of the trp operon with a feedback resistant form of trpE on a second plasmid (ΔtrpRΔtnaA, tet-aroGfbr, tet-trpEfbrDCBA). SYN2473 comprises ΔtrpRΔtnaA and a first tetracycline inducible construct for the expression of feedback resistant aroG and SerA on a first plasmid and a second tetracycline inducible construct with the genes of the trp operon with a feedback resistant form of trpE on a second plasmid (ΔtrpRΔtnaA, tet-aroGfbr-serA, tet-trpEfbrDCBA). SYN2476 comprises ΔtrpRΔtnaA and a tetracycline inducible construct with the genes of the trp operon with a feedback resistant form of trpE on a plasmid (ΔtrpRΔtnaA, tet-trpEfbrDCBA).

Figure 6D:
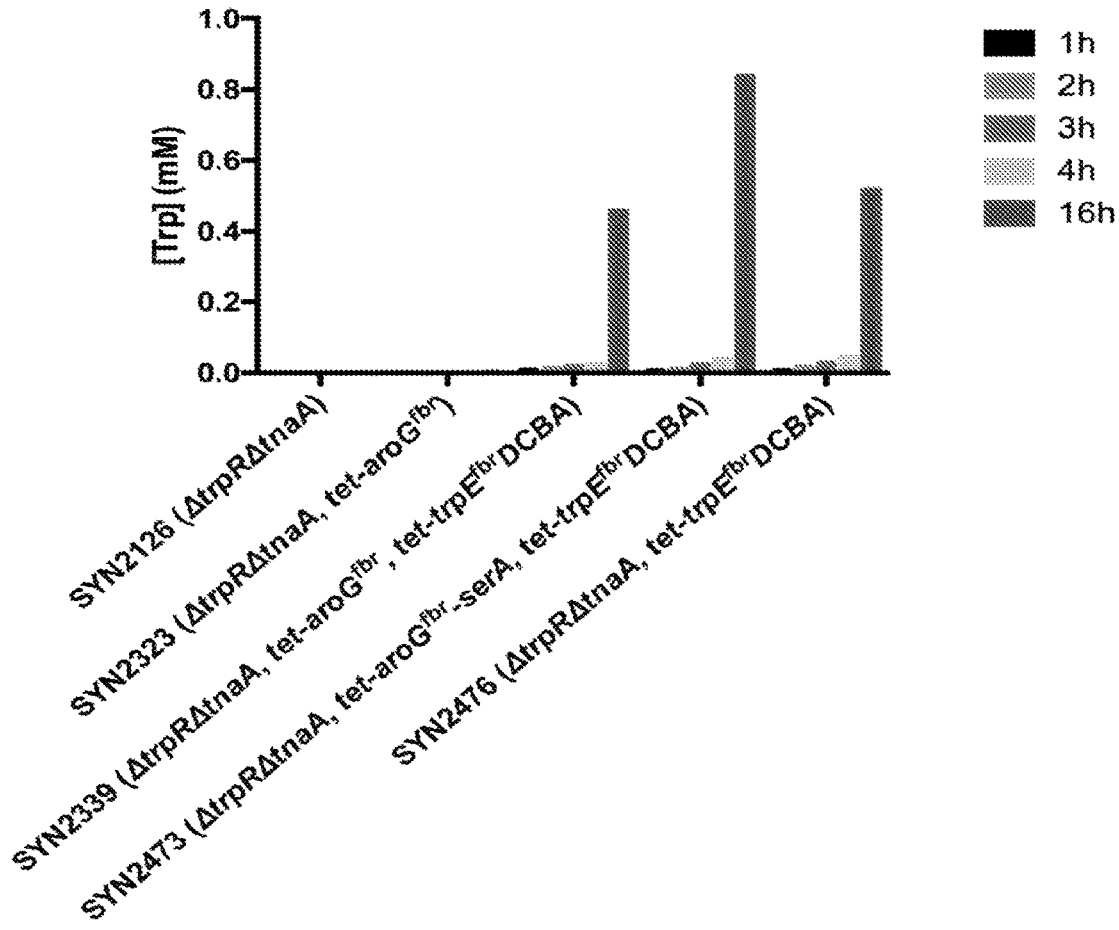
Figure 7:
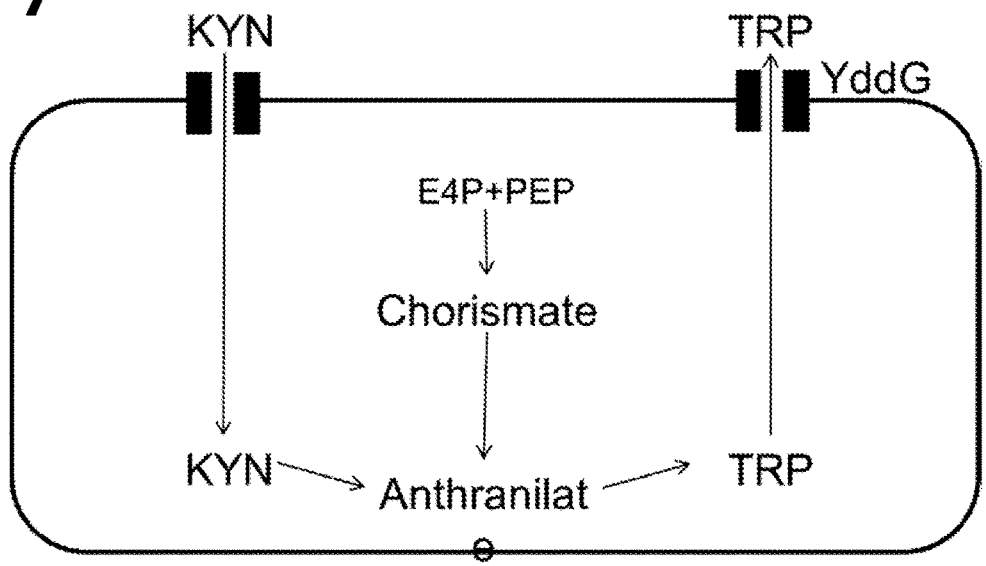
FIG. 7 depicts a schematic of exemplary embodiments of the disclosure, in which the genetically engineered bacteria comprise circuits for the production of tryptophan and the degradation of kynurenine
Figure 8:
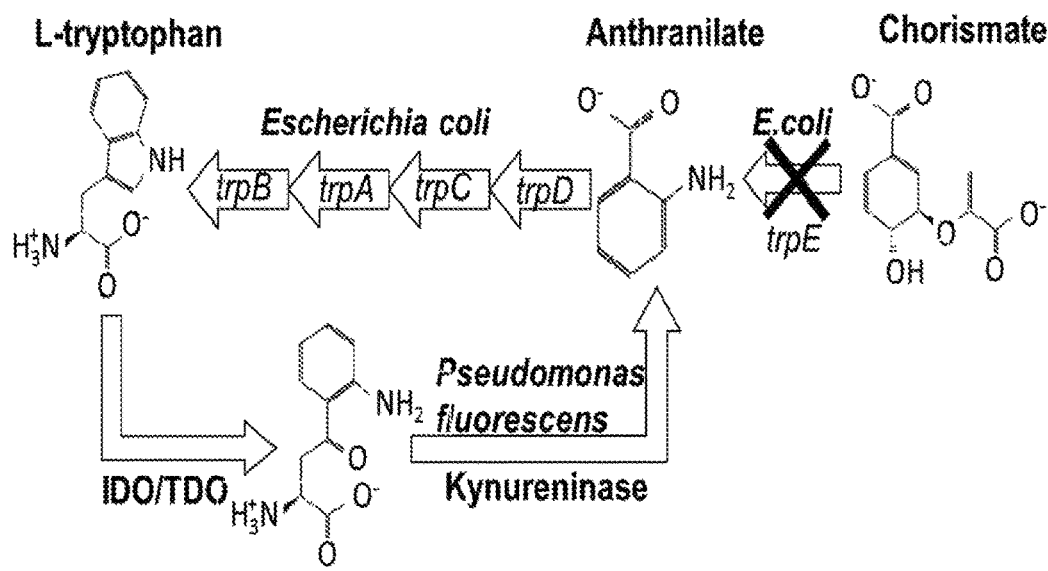
FIG. 8 depicts a schematic of one embodiment of the disclosure. In this embodiment, tryptophan is synthesized from kynurenine. Through this conversion, an immune-suppressive metabolite (kynurenine) can be removed from the external environment, e.g., a tumor environment, and a pro-inflammatory metabolite (tryptophan) is generated. Kynureninase from *Pseudomonas fluorescens* converts KYN to AA (Anthranillic acid), which then can be converted to tryptophan through the enzymes of the *E. coli* trp operon. Optionally, the trpE gene may be deleted as it is not needed for the generation of tryptophan from kynurenine. In alternate embodiments, the trpE gene is not deleted, in order to maximize tryptophan production by using both kynurenine and chorismate as a substrate. In one embodiment of the invention, the genetically engineered bacteria comprising this circuit may be useful for reducing immune escape in cancer.

Overnight cultures were diluted 1/100 in 3 mL LB plus antibiotics and grown for 2 hours (37 C, 250 rpm). Next, cells were induced with 100 ng/mL ATC for 2 hours (37 C, 250 rpm), spun down, washed with cmL M9, spun down again and resuspended in 3 mL M9+1% glucuronate. Cells were plated for CFU counting. For the assay, the cells were placed at 37 C with shaking at 250 rpm. Supernatants were collected at 1h, 2h, 3h, 4h 16h for HPLC analysis for tryptophan. As seen in FIG. 6D, results indicate that expressing aroG is not sufficient nor necessary under these conditions to get Trp production and that expressing serA is beneficial for tryptophan production.

Example 12. ALE

First, strains were generated, which comprise the trpE knock out and integrated constructs for the expression of Pseudomonas fluorescens KYNase driven by a constitutive promoter (Table 24). KYNase constructs were integrated at the HA3/4 site, and two different promoters were used; the promoter of the endogenous lpp gene was used in parental strain SYN2027 (HA3/4::Plpp-pKYNase KanR TrpE::CmR) and the synthetic pSynJ23119 was used in parental strain SYN2028 (HA3/4::PSynJ23119-pKYNase KanR TrpE::CmR). These strains were generated so that a strain would be evolved, which would comprise a chromosomally integrated version of Pseudomonas fluorescens KYNase. (see Table 24).

TABLE 24

Constructs for Constitutive Expression of Pseudomonas fluorescens Kynureninase

| Description | SEQ ID NO: |
|---|---|
| Pseudomonas fluorescens, codon optimized for expression in E. coli, driven by the SYN23119; Construct can be expressed from a plasmid, e.g., p15 or can be integrated into the chromosome, e.g., at the HA3/4 site | 890 |
| Pseudomonas fluorescens kynureninase driven by Lpp promoter from E. coli; Construct can be expressed from a plasmid, e.g., p15 or can be integrated into the chromosome, e.g., at the HA3/4 site | 893 |

These strains were validated in the checkerboard assay (e.g., as described in International Patent Application PCT/US2017/013072, filed Jan. 11, 2017, published as WO2017/123675, the contents of which is herein incorporated by reference in its entirety) to have similar ALE parameters to their plasmid-based Ptet counterpart. Lower limit of kynurenine (KYN) and ToxTrp concentration for use in the ALE experiment were established using the checkerboard assay described in PCT/US2017/013072, and lower limit concentrations corresponded to those observed for the strains expressing tet inducible KYNase from a medium copy plasmid.

Mutants derived from parental strains SYN2027 and SYN2028 were evolved by passaging in lowering concentrations of KYN and three different ToxTrp concentrations as follows.

The ALE parental strains were cultured on plates with M9 minimal media supplemented with glucose and L-kynurenine (M9+KYN). A single colony from each parent was selected, resuspended in 20 uL of sterile phosphate-buffered saline solution. This colony was then used to inoculate two cultures of M9+KYN, grown into late-logarithmic phase and the optical density was determined at 600 nm. These cultures were then diluted to $10^3$ in 3 columns of a 96-well deep-well plate with 1 mL of M9+KYNU. Each one of the three rows had different ToxTrp concentrations (increasing 2-fold), while each column had decreasing concentrations of KYN (by 2-fold). Every 12 hours, the plate was diluted back using 30 uL from the well in which the culture had grown to an OD600 of roughly 0.1. This process was repeated for five days, and then the ToxTrp concentrations were doubled to maintain selection pressure. After two weeks' time, no growth rate increases were detected and the culture was plated onto M9+KYN. All culturing was done shaking at 350 RPM at 37° C. Individual colonies were selected and screened in M9+KYN+ToxTrp media to confirm increased growth rate phenotype.

Two replicates for each parental strain (SYN20207-R1, SYN2027-R2, SYN2028-R1, and SYN2028-R2) were selected and assayed for kynurenine production.

Figure 9:
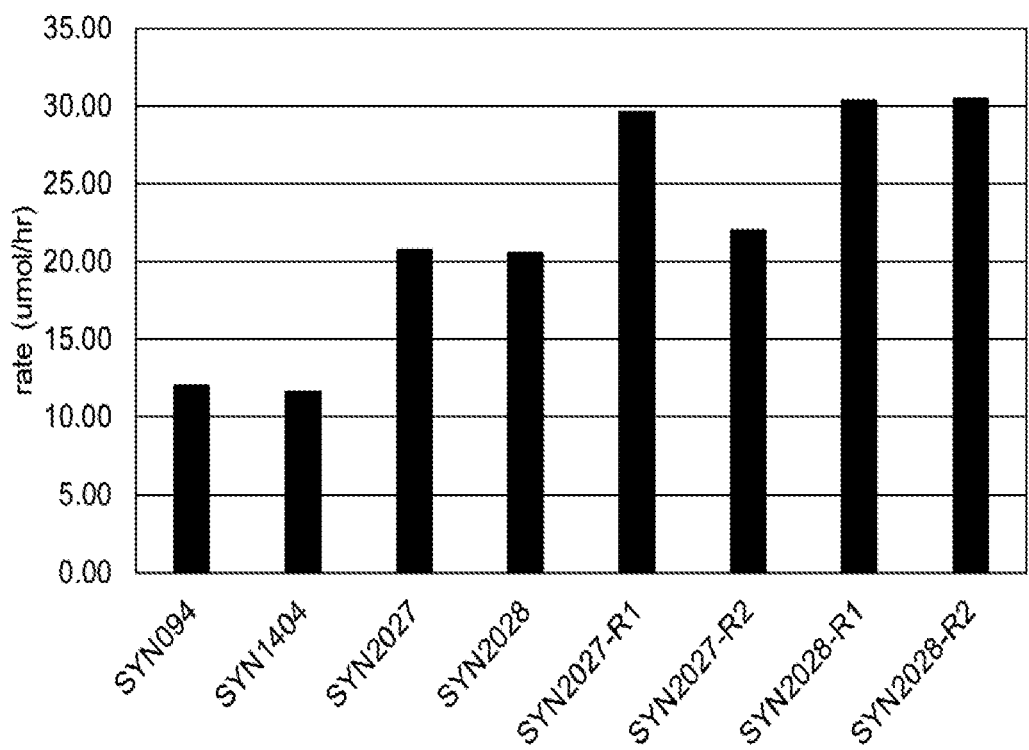
FIG. 9 depicts a bar graph showing the kynurenine consumption rates of original and ALE evolved kynureninase expressing strains in M9 media supplemented with 75 uM kynurenine. Strains are labeled as follows: SYN1404: *E. coli* Nissle comprising a deletion in Trp:E and a medium copy plasmid expressing kynureninase from *Pseudomonas fluorescens* under the control of a tetracycline inducible promoter (Nissle delta TrpE::CmR+Ptet-*Pseudomonas* KYNU p15a KanR); SYN2027: *E. coli* Nissle comprising a deletion in Trp:E and expressing kynureninase from *Pseudomonas fluorescens* under the control of a constitutive promoter (the endogenous lpp promoter) integrated into the genome at the HA3/4 site (HA3/4::Plpp-pKYNase KanR TrpE::CmR); SYN2028: *E. coli* Nissle comprising a deletion in Trp:E and expressing kynureninase from *Pseudomonas fluorescens* under the control of a constitutive promoter (the synthetic J23119 promoter) integrated into the genome at the HA3/4 site (HA3/4::PSynJ23119-pKYNase KanR TrpE::CmR); SYN2027-R1: a first evolved strain resulting from ALE, derived from the parental SYN2027 strain (Plpp-pKYNase KanR TrpE::CmR EVOLVED STRAIN Replicate 1). SYN2027-R2: a second evolved strain resulting from ALE, derived from the parental SYN2027 strain (Plpp-pKYNase KanR TrpE::CmR EVOLVED STRAIN Replicate 2). SYN2028-R1: a first evolved strain resulting from ALE, derived from the parental SYN2028 strain (HA3/4::PSynJ23119-pKYNase KanR TrpE::CmR EVOLVED STRAIN Replicate 1). SYN2028-R2: a second evolved strain resulting from ALE, derived from the parental SYN2028 strain (HA3/4::PSynJ23119-pKYNase KanR TrpE::CmR EVOLVED STRAIN Replicate 1).

Briefly, overnight cultures were diluted 1:100 in 400 ml LB and let grow for 4 hours. Next, 2 ml of the culture was spun down and resuspended in 2 ml M9 buffer. The OD600 of the culture was measured (1/100 dilution in PBS). The necessary amount of cell culture for a 3 ml assay targeting starting cell count of ~OD 0.8 (~1E8) was spun down. The cell pellet was resuspended in M9+0.5% glucose+75 uM KYN in the assay volume (3 ml) in a culture tube. 220 ul was removed in triplicate at each time point (t=0, 2, and 3 hours) into conical shaped 96WP, and 4 ul were removed for cfu measurement at each time point. At each time point, the sample was spun down in the conical 96WP for 5 minutes at 3000 g, and 200 ul were transferred from each well into a clear, flat-bottomed, 96WP. A kynurenine standard curve and blank sample was prepared in the same plate. Next, 40 ul of 30% Tri-Chloric Acid (v/v) was added to each well and mixed by pipetting up and down. The plat was sealed with aluminum foil and incubated at 60 C for 15 minutes. The plate was the spun down at 11500 rpm, at 4 C, for 15 minutes, and 125 ul from each well were aliquoted and mixed with 125 ul of 2% Ehrlich's reagent in glacial acetic acid in another 96WP. Samples were mixed pipetting up and down and the absorbance was measured at OD480. Growth rates are shown for parental strains SYN2027 and SYN2028 and the corresponding evolved strains in FIG. 9.

Example 13. Kynurenine Consuming Strains Decrease Tumoral Kynurenine Levels in the CT26 Murine Tumor Model The ability of genetically engineered bacteria comprising kynureninase from *Pseudomonas fluorescens* to consume kynurenine in vivo in the tumor environment was assessed. SYN1704, an *E. coli* Nissle strain comprising a deletion in Trp:E and a medium copy plasmid expressing kynureninase from *Pseudomonas fluorescens* under control of a constitutive promoter (Nissle delta TrpE::CmR+Pconstitutive-*Pseudomonas* KYNU KanR) was used for in a first study (Study 1).

In a second study (Study 2) the activity of SYN2028, an *E. coli* Nissle strain comprising a deletion in Trp:E and an integrated construct expressing kynureninase from *Pseudomonas fluorescens* under the control of a constitutive promoter (Nissle HA3/4::PSynJ23119-pKYNase KanR TrpE::CmR) was assessed.

In both studies, CT26 cells obtained from ATCC were cultured according to guidelines provided. Approximately ~1e6 cells/mouse in PBS were implanted subcutaneously into the right flank of each animal (BalbC/J (female, 8 weeks)), and tumor growth was monitored for approximately 10 days. When the tumors reached about ~100-150 mm3, animals were randomized into groups for dosing.

For intratumoral injection, bacteria were grown in LB broth until reaching an absorbance at 600 nm (A600 nm) of 0.4 (corresponding to 2×108 colony-forming units (CFU)/mL) and washed twice in PBS. The suspension was diluted in PBS or saline so that 100 microL can be injected at the appropriate doses intratumorally into tumor-bearing mice.

Figure 10A:
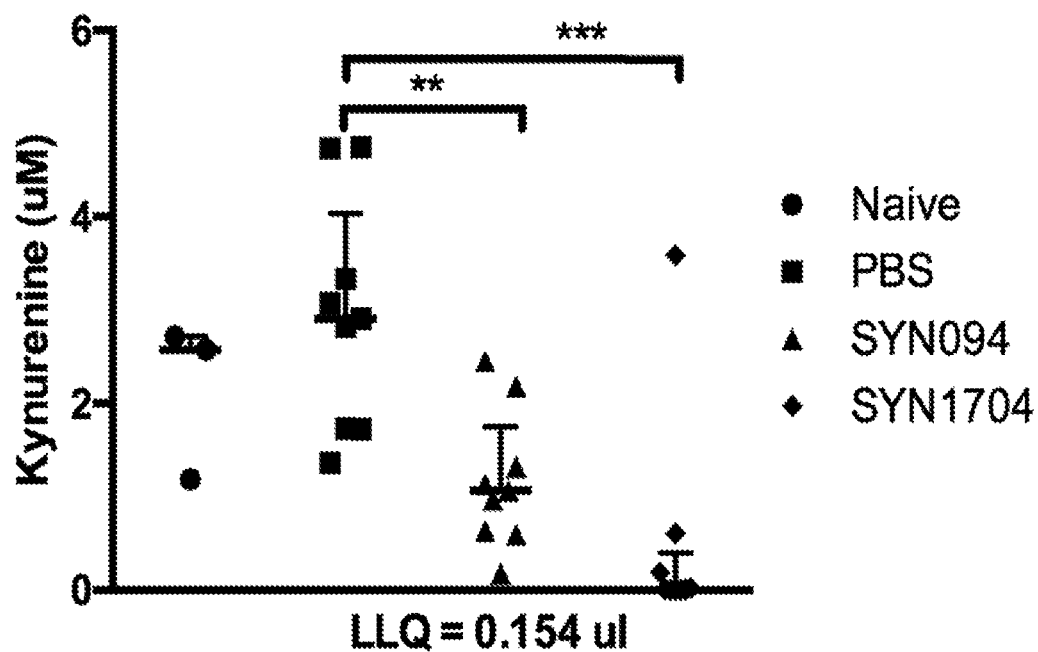
FIG. 10A and FIG. 10B depict dot plots showing intratumoral kynurenine depletion by strains producing kynureninase from *Pseudomonas fluorescens*.

Study 1: Approximately 10 days after CT 26 implantation, bacteria were suspended in 0.1 ml of PBS and mice were injected (5e6 cells/mouse) with 100 ul intratumorally as follows: Group 1-Vehicle Control (n=8), Group 2-SYN94 (n=8), and Group 3-SYN1704 (n=8). From Day 2 until study end, animals were dosed intratumorally biweekly with 100 ul of vehicle control or bacteria at 5e6 cells/mouse. Animals were weighed and the tumor volume measured twice weekly. Animals were euthanized when the tumors reached ~2000 mm3 and kynurenine concentrations were measured by LC/MS as described herein. Results are shown in FIG. 10A. A significant reduction in intra tumor concentration was observed for the kynurenine consuming strain SYN1704 and for wild type *E. coli* Nissle. Intratumoral kynurenine levels were reduced in SYN1704, as compared to wild type Nissle, although the difference did not reach significance due to one outlier.

Figure 10B:
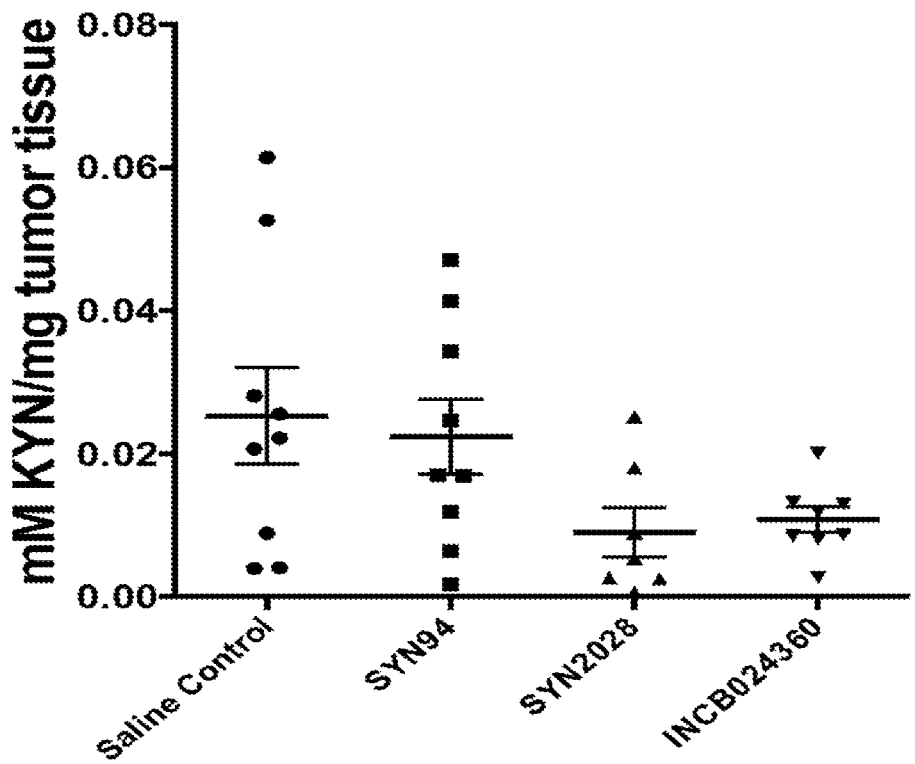
Figure 11:
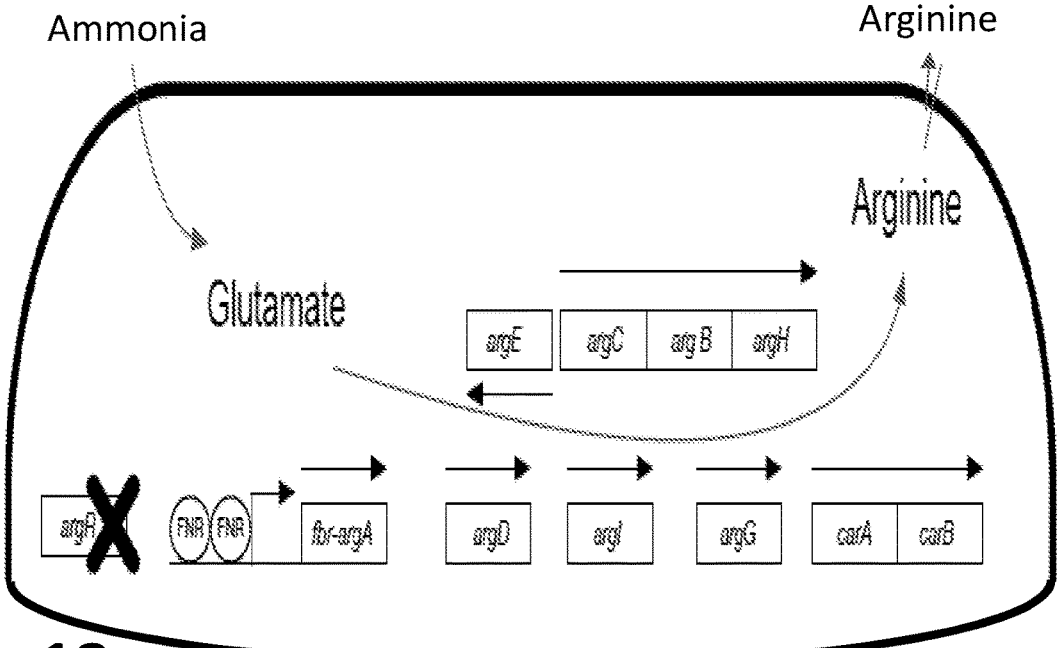
FIG. 11 depicts an exemplary embodiment of an engineered bacterial strain deleted for the argR gene and expressing the feedback-resistant argA$^{fbr}$ gene. This strain further comprises one or more auxotrophic modifications on the chromosome. This strain is useful for the production of arginine.
Figure 12:
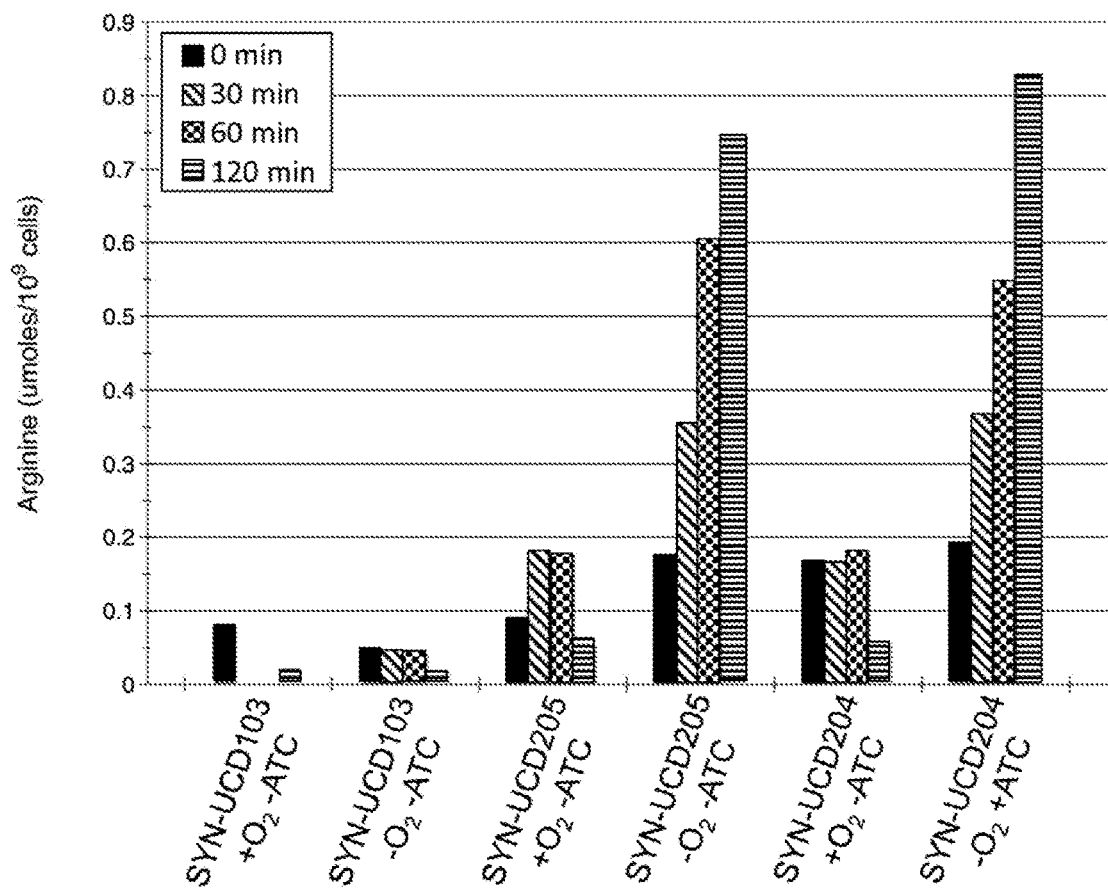
FIG. 12 depicts a bar graph of in vitro arginine levels produced by streptomycin-resistant Nissle (SYN-UCD103), SYN-UCD205, and SYN-UCD204 under inducing (+ATC) and non-inducing (–ATC) conditions, in the presence (+O$_2$) or absence (–O$_2$) of oxygen. SYN-UCD103 is a control Nissle construct. SYN-UCD205 comprises ΔArgR and argA$^{fbr}$ expressed under the control of a FNR-inducible promoter on a low-copy plasmid. SYN204 comprises ΔArgR and argA$^{fbr}$ expressed under the control of a tetracycline-inducible promoter on a low-copy plasmid.

Study 2: Approximately 10 days after CT 26 implantation, bacteria were suspended in 0.1 ml of saline and mice were injected (1e8 cells/mouse) with the bacterial suspension intratumorally as follows: Group 1-Vehicle Control (n=10), Group 2-SYN94 (n=10), Group 3-SYN2028 (n=10). Group 5 (n=10) received INCB024360 (IDO inhibitor) via oral gavage as a control twice daily. From Day 2 until study end, animals were dosed intratumorally biweekly with 100 ul of vehicle control or bacteria at 1e8 cells/mouse. Animals were weighed and the tumor volume measured twice weekly. Group 5 received INCB024360 via oral gavage as a control twice daily until study end. Animals were euthanized when the tumors reached ~2000 mm3. Tumor fragments were placed in pre-weighed bead-buster tubes and store don ice for analysis. Kynurenine concentrations were measured by LC/MS as described herein. Results are shown in FIG. 10B. A significant reduction in intra tumor concentration was observed for the kynurenine consuming strain SYN2028 as compared to wild type Nissle or wild type control. Intratumoral kynurenine levels seen in SYN2028 were similar to those observed for the IDO inhibitor INCB024360.

Example 14. Comparison of In Vitro Efficacy of Chromosomal Insertion and Plasmid-Bearing Engineered Bacterial Strains To compare the in vitro efficacy between engineered bacterial strains harboring a chromosomal insertion of ArgAfbr driven by an fnr inducible promoter at the malEK locus and strains with a low copy plasmid comprising ArgAfbr driven by an fnr inducible promoter, arginine levels in the media were measured at various time points post anaerobic induction. Additionally, to assess whether auxotrophy for thymidine may have an effect on arginine production efficiency, arginine production of engineered bacterial strains with or without a ThyA deletion, comprising the fnr-ArgAfbr on a low copy plasmid or integrated on the chromosome, were compared.

Overnight cultures were diluted 1:100 in LB and grown with shaking (250 rpm) at 37° C. After 1.5 hrs of growth, the bacteria cultures were induced as follows: (1) bacteria comprising FNR-inducible argA$^{fbr}$ were induced in LB at 37° C. for 4 hrs in anaerobic conditions in a Coy anaerobic chamber (supplying 90% N2, 5% $CO_2$, 5% $H_2$, and 20 mM nitrate) at 37° C.; (2) bacteria comprising tetracycline-inducible argA$^{fbr}$ were induced with anhydrotetracycline (100 ng/mL). After induction, bacteria were removed from the incubator and spun down at maximum speed for 5 min. The cells were resuspended in 1 mL M9 glucose, and the $OD_{600}$ was measured. Cells were diluted until the $OD_{600}$ was between 0.6-0.8. Resuspended cells in M9 glucose media were grown aerobically with shaking at 37 C. 100 µL of the cell resuspension was removed and the $OD_{600}$ is measured at time=0. A 100 µL aliquot was frozen at −20° C. in a round-bottom 96-well plate for mass spectrometry analysis (LC-MS/MS). At each subsequent time point (e.g., 30, 60, and 120 min), 100 µL of the cell suspension was removed and the $OD_{600}$ was measured; a 100 µL aliquot was frozen at −20 C in a round-bottom 96-well plate for mass spectrometry analysis. Samples were analyzed for arginine concentrations. At each time point, normalized concentrations as determined by mass spectrometry vs. $OD_{600}$ were used to determine the rate of arginine production per cell per unit time. A summary of the LC-MS/MS method is provided above.

Arginine production at 30, 60, and 120 min post induction was compared between (1) Syn-UCD301 (SYN825; comprising ΔArgR and argA$^{fbr}$ expressed under the control of a FNR-inducible promoter integrated into the chromosome at the malEK locus), (2) SYN-UCD205 (comprising ΔArgR and argA$^{fbr}$ expressed under the control of a FNR-inducible promoter on a low-copy plasmid), and (3) SYN-UCD206 (comprising ΔArgR and ΔThyA and argA$^{fbr}$ expressed under the control of a FNR-inducible promoter on a low-copy plasmid. SYN-UCD103 was used as is a control Nissle construct and results are shown.

Shown herein are the levels of arginine production of SYN-UCD205, SYN-UCD206, and SYN-UCD301 measured at 0, 30, 60, and 120 minutes. Arginine production was comparable between all three strains, with the greatest arginine production seen with SYN-UCD301 at 120 minutes, indicating that chromosomal integration of FNR ArgA fbr results in similar levels of arginine production as seen with the low copy plasmid strains expressing the same construct, and may even slightly increase the rate of arginine production. SYN-UCD206 exhibited attenuated arginine production as compared to SYN-UCD205 and SYN-UCD-301 (lower arginine levels at 60 minutes), but reached comparable arginine production levels at 120 minutes, indicating that ΔThyA may have a slight attenuating effect on arginine production. No arginine production was detected for the SYN-UCD103 control.

Next, samples were prepared as described above and arginine production at 120 min post induction was compared between (1) SYN-UCD204 (comprising ΔArgR and argA$^{fbr}$ expressed under the control of a tetracycline-inducible promoter on a low-copy plasmid), and (2) SYN-UCD301 (comprising ΔArgR, CmR and argA$^{fbr}$ expressed under the control of a FNR-inducible promoter integrated into the chromosome at the malEK locus), (3) SYN-UCD302 (comprising ΔArgR, ΔThyA, CmR (chloramphenicol resistance) and argAfbr expressed under the control of a FNR-inducible promoter integrated into the chromosome at the malEK locus), and (4) SYN-UCD303 (comprising ΔArgR, ΔThyA, KanR (kanamycin resistance) and argAfbr expressed under the control of a FNR-inducible promoter integrated into the chromosome at the malEK locus).

Figure 13A:
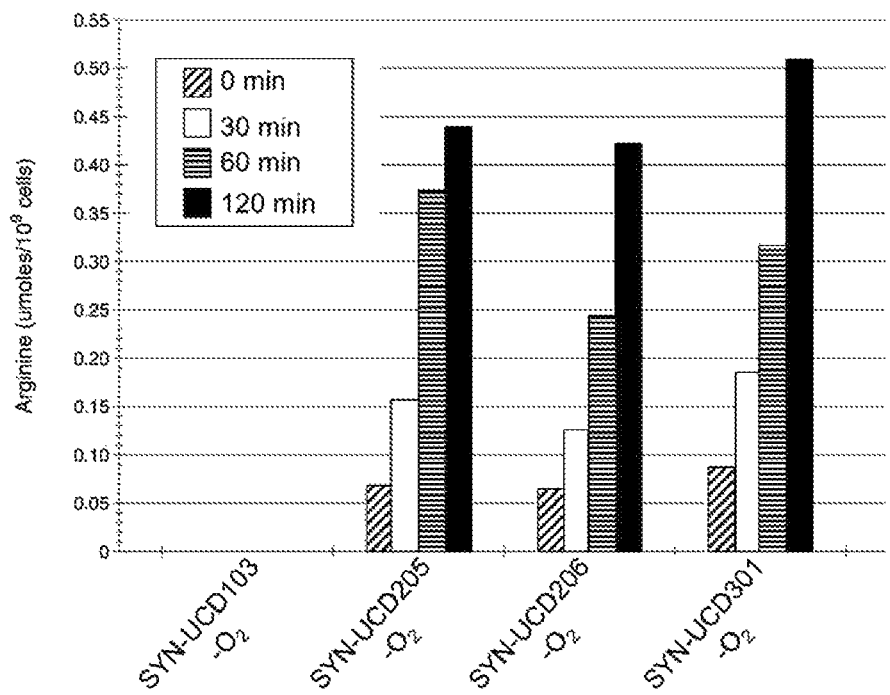
FIG. 13A and FIG. 13B depict bar graphs of ammonia levels in the media at various time points post anaerobic induction.
Figure 13B:
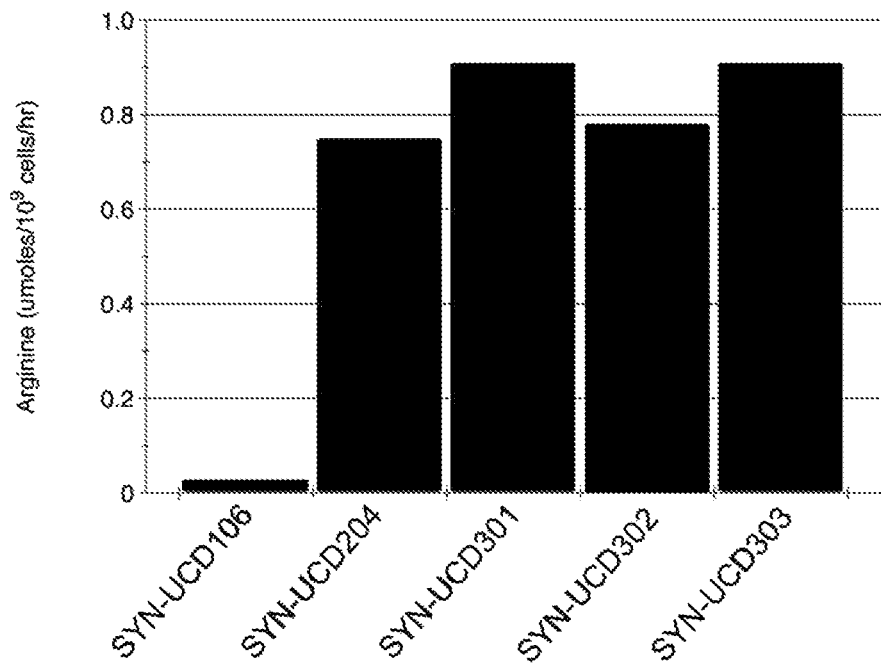

SYN-UCD106, comprising ΔArgR and ΔThyA was used as is a control Nissle construct. Results are shown in FIG. 13B. As seen in FIG. 13B, arginine production was elevated to between 0.7 and 0.9 umol/1×10$^9$ cells, indicating that arginine production is at similar levels in strains bearing ArgAfbr on a plasmid and strains with integrated copies of ArgAfbr.

Example 15. Comparison of In Vitro Efficacy of Chromosomal Insertion and Plasmid-Bearing Engineered Bacterial Strains The in vitro efficacy (arginine production from ammonia) in an engineered bacterial strain harboring a chromosomal insertion of ArgAfbr driven by an fnr inducible promoter at the malEK locus, with ΔArgR and a ThyA deletion and no antibiotic resistance was assessed (SYN-UCD303).

Figure 14:
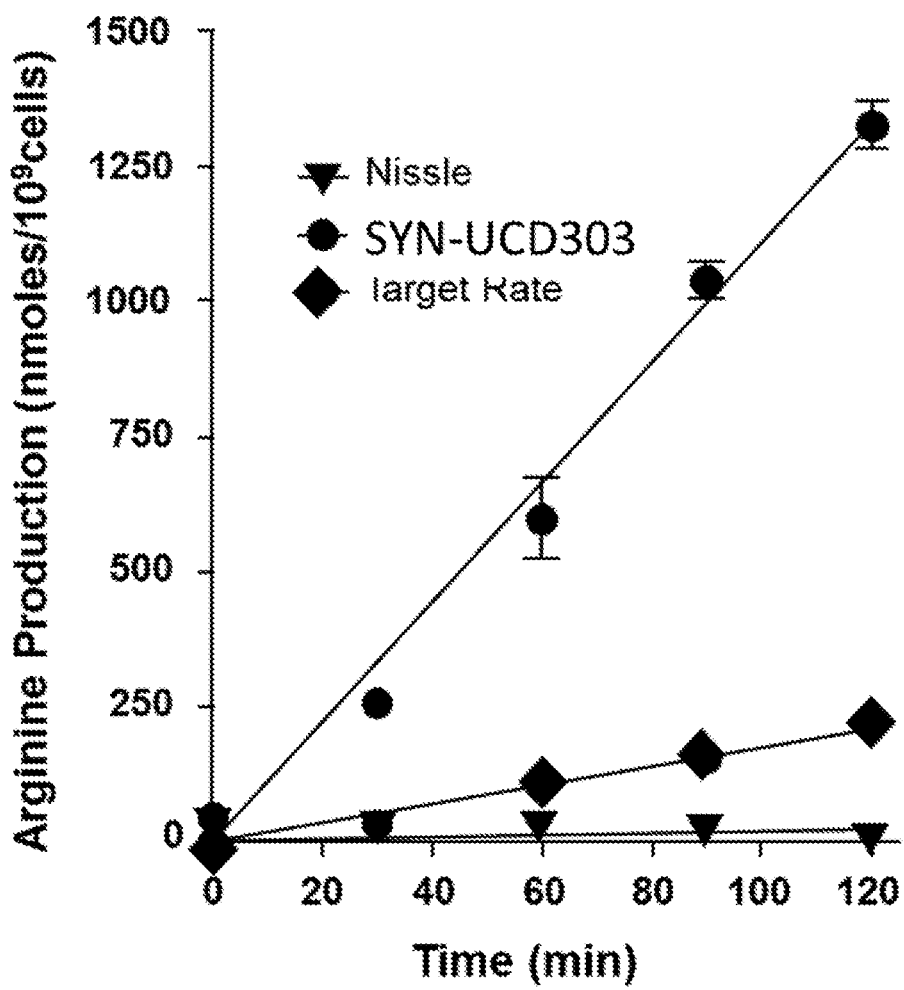
FIG. 14 depicts a line graph showing the in vitro efficacy (arginine production from ammonia) in an engineered bacterial strain harboring a chromosomal insertion of ArgAfbr driven by an fnr inducible promoter at the malEK locus, with ΔArgR and ΔThyA and no antibiotic resistance was assessed (SYN-UCD303). Streptomycin resistant *E. coli* Nissle (Nissle) is used as a reference.
Figure 15A:
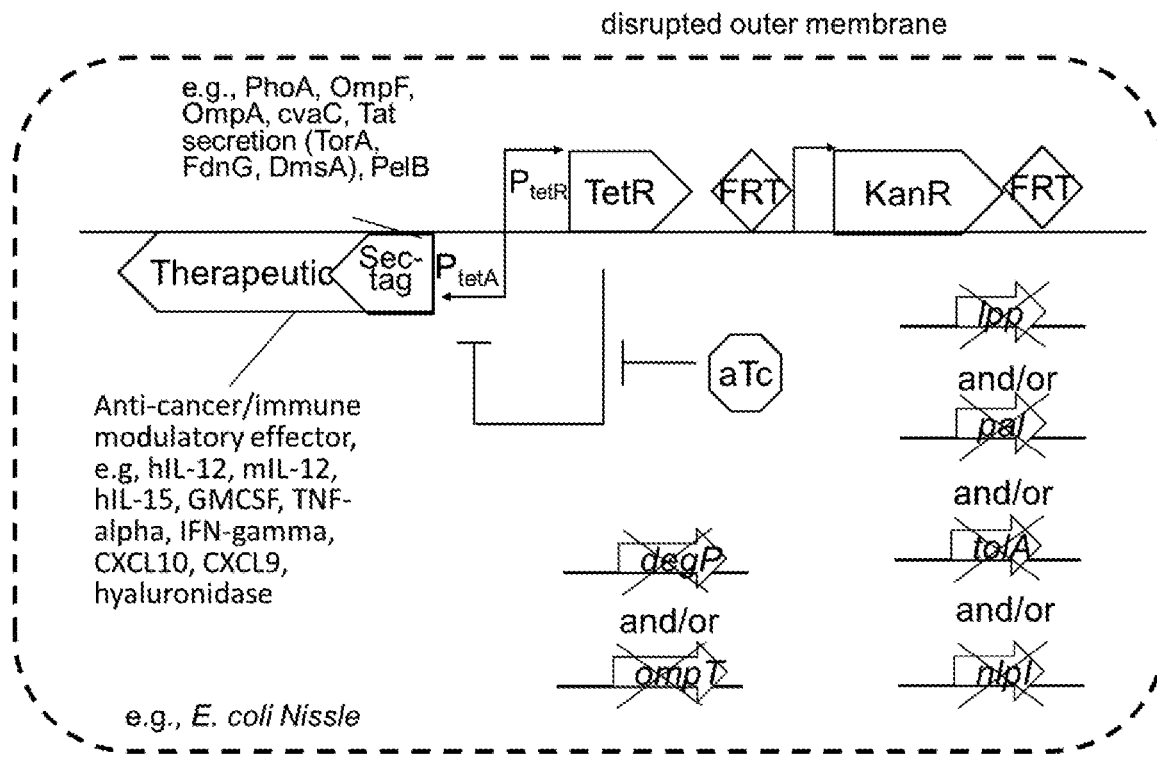
FIG. 15A and FIG. 15B depict schematics of the gene organization of exemplary circuits of the disclosure for the expression of therapeutic polypeptides, e.g., anti-cancer/immune modulatory effectors described herein, e.g., hIL-12, mIL-12, hIL-15, GMCSF, TNF-alpha, IFN-gamma, CXCL10, CXCL9, and/or hyaluronidase, which are secreted via a diffusible outer membrane (DOM) system. The therapeutic polypeptide of interest is fused to a prototypical N-terminal Sec-dependent secretion signal or Tat-dependent secretion signal, which is cleaved upon secretion into the periplasmic space. Exemplary secretion tags include sec-dependent PhoA, OmpF, OmpA, cvaC, and Tat-dependent tags (TorA, FdnG, DmsA). In certain embodiments, the genetically engineered bacteria comprise deletions in one or more of lpp, pal, tolA, and/or nlpI. Optionally, periplasmic proteases are also deleted, including, but not limited to, degP and ompT, e.g., to increase stability of the polypeptide in the periplasm. A FRT-KanR-FRT cassette is used for downstream integration. Expression is driven by a tet promoter (FIG. 15A) or an inducible promoter, such as oxygen level-dependent promoters (e.g., FNR-inducible promoter, FIG. 15B), and promoters induced by a metabolite that may or may not be naturally present (e.g., can be exogenously added) in the gut, e.g., arabinose. In certain embodiments, the one or more cassettes are under the control of constitutive promoters.
Figure 15B:
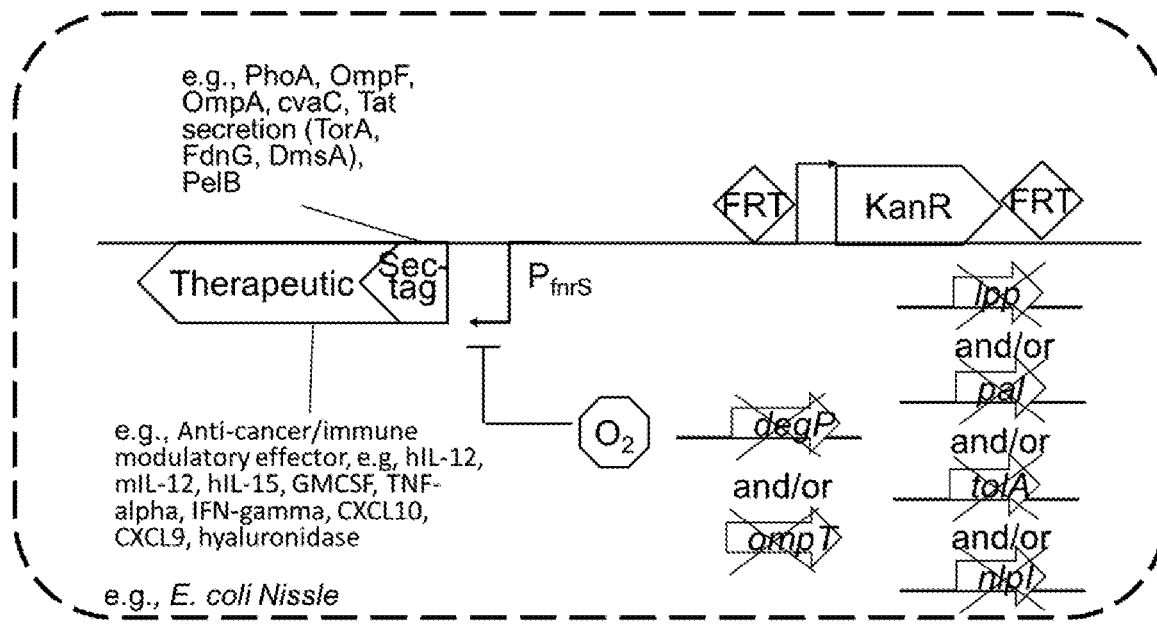
Figure 16:
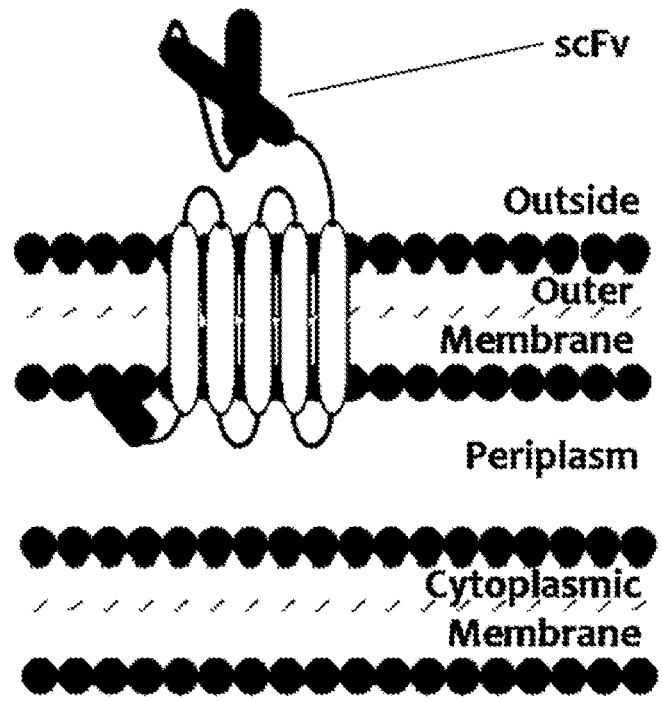
FIG. 16 depicts a schematic of a polypeptide of interest displayed on the surface of the bacterium. A non-limiting example of such a therapeutic protein is a scFv. The polypeptide is expressed as a fusion protein, which comprises an outer membrane anchor from another protein, which was developed as part of a display system. Non-limiting examples of such anchors are described herein and include LppOmpA, NGIgAsig-NGIgAP, InaQ, Intimin, Invasin, pelB-PAL, and blcA/BAN. In a nonlimiting example a bacterial strain which has one or more diffusible outer membrane phenotype ("leaky membrane") mutation, e.g., as described herein.
Figure 17:
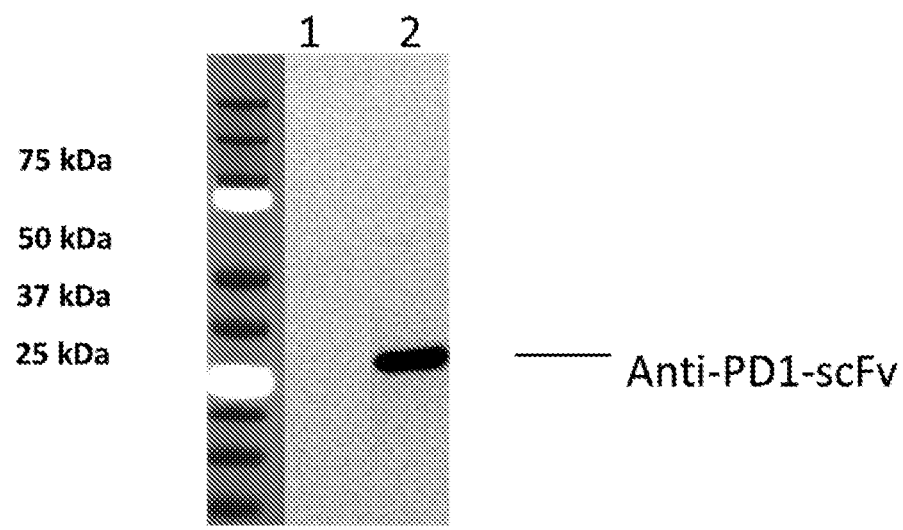
FIG. 17 depicts a Western Blot analysis of total cytosolic extracts of a wild type *E. coli* (lane 1) and of a strain expressing anti-PD1 scFv (lane 2).

Overnight cultures were diluted 1:100 in LB and grown with shaking (250 rpm) at 37° C. After 1.5 hrs of growth, the bacteria cultures were induced in LB at 37° C. for 4 hrs in anaerobic conditions in a Coy anaerobic chamber (supplying 90% $N_2$, 5% $CO_2$, 5% H2, and 20 mM nitrate) at 37° C. After induction, bacteria were removed from the incubator and spun down at maximum speed for 5 min. The cells were resuspended in 1 mL M9 glucose, and the $OD_{600}$ was measured. Cells were diluted until the $OD_{600}$ was between 0.6-0.8. Resuspended cells in M9 glucose media were grown aerobically with shaking at 37 C. 100 μL of the cell resuspension was removed and the $OD_{600}$ is measured at time=0. A 100 μL aliquot was frozen at −20° C. in a round-bottom 96-well plate for mass spectrometry analysis (LC-MS/MS). At each subsequent time point (e.g., 20, 40, 60, 80, 100, and 120 min), 100 μL of the cell suspension was removed and the $OD_{600}$ was measured; a 100 μL aliquot was frozen at −20 C in a round-bottom 96-well plate for mass spectrometry analysis. Samples were analyzed for arginine concentrations. At each time point, normalized concentrations as determined by mass spectrometry vs. $OD_{600}$ were used to determine the rate of arginine production per cell per unit time. A summary of the LC-MS/MS method is provided herein. Results are shown in FIG. 14.

Example 16. Generation of Constructs and Bacteria for Cytokine Secretion

To produce strains capable of secreting immune modulatory polypeptides, e.g., cytokines, such as hIL-12, mIL-12, hIL-15, GMCSF, TNF-alpha, IFN-gamma, CXCL9 and CXCL10, several constructs were designed employing different secretion strategies. Various cytokine constructs were synthesized, and cloned into vector pBR322 for transformation of E. coli. In some embodiments, the constructs encoding the effector molecules are integrated into the genome. In some embodiments, the constructs encoding the effector molecules are on a plasmid, e.g., a medium copy plasmid.

Example 17. Activity of Kynurenine Consuming Strain in Combination with Systemic Anti-PD-1 and Anti-CTLA-4 in the MC38 Model The ability of the kynurenine consuming strain SYN2028 to augment the anti-tumor response of combined anti-CTLA4 and anti-PD-1 was assessed in the C57BL/6-MC38 syngeneic tumor model.

To produce cells used in the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Mice were implanted with MC38 tumors, and mice injected intratumorally with the kynurenine consuming bacteria and intraperitoneally with anti-CTLA-4 and anti-PD-1 antibodies according to the study design in Table 52. MC38 cells were implanted (1×105/mouse/100 μL) SC into the right flank of each animal on day −9. Tumor growth was monitored; when the tumors reached ~50-80 mm^3 on day 1, mice were randomized into treatment groups as shown in Table 52.

Tumor volumes and body weights were recorded three times in a week with a gap of 1-2 days in between two measurements.

TABLE 52

| | | Treatment 1 | | | | Treatment 2 | | | | |
|---|---|---|---|---|---|---|---|---|---|---|
| Group | N | Test Article | Route | Dose | Schedule | Test Article | Route | Dose | Schedule | Treatment 3 Compound |
| 1 | 12 | Anti-PD-1 Isotype Control | i.p. | 200 ug | Day 1, 4, 7 and 10 | Anti-CTLA-4 Isotype Control | i.p. | 100 ug | Day 1, 4, 7 and 10 | NA |
| 2 | 12 | Anti-PD-1 | i.p. | 200 ug | Day 1, 4, 7 and 10 | Anti-CTLA-4 | i.p. | 100 ug | Day 1, 4, 7 and 10 | NA |
| 3 | 12 | Anti-PD-1 | i.p. | 200 ug | Day 1, 4, 7 and 10 | Anti-CTLA-4 | i.p. | 100 ug | Day 1, 4, 7 and 10 | SYN094, 5e6 bacteria, i.t., BIWx2 |
| 4 | 12 | Anti-PD-1 | i.p. | 200 ug | Day 1, 4, 7 and 10 | Anti-CTLA-4 | i.p. | 100 ug | Day 1, 4, 7 and 10 | SYN2028, 5e6 bacteria, i.t., BIWx2 |

Results in FIGS. 39A, 39B, 39C, 39D, and 39E show that the kynurenine consuming strain has the ability to improve anti-CTLA-4/anti-PD-1 antibody-mediated anti-tumor activity in the MC38 model. Specifically, in the anti-PD-1/anti-CTLA-4 group, 25% of mice responded to the treatment; same response rate was observed with anti-PD-1/anti-CTLA-4 plus SYN94 group. In the anti-PD-1/anti-CTLA-4 plus SYN2028 group, 71% of mice responded.

Example 18. Activity of Arginine Producer and Kynurenine Consumer in Combination with Nonmyeloablative Chemotherapy The activity of the arginine producer (SYN828) and kynurenine consumer (SYN2028) was assessed in combination with cyclophosphamide treatment in the CT26 tumor model.

To produce cells for the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Figure 40A:
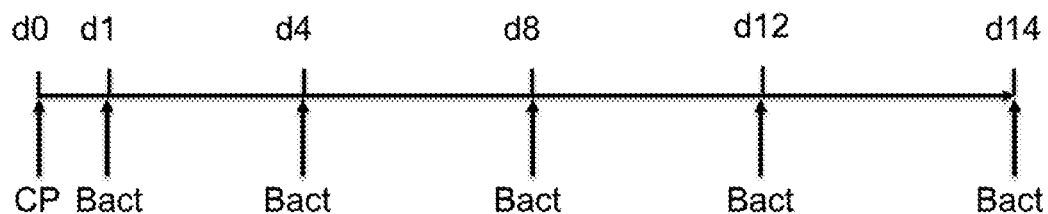
FIG. 40A depicts a chart showing the administration schema for the study shown in 40B, 40C, 40D, 40E, and 40F.
Figure 40B:
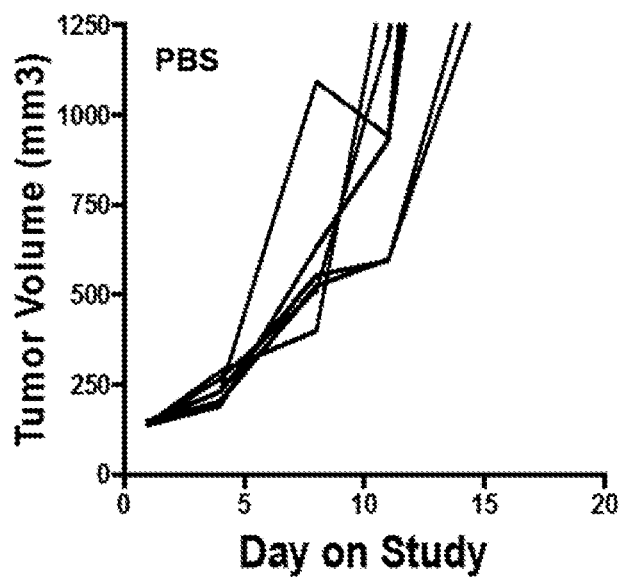
FIGS. 40B, 40C, 40D, 40E, and 40F depict a line graphs for each individual mouse of an in vivo analysis of the effect on tumor volume of a combination treatment with the chemotherapeutic agent cyclophosphamide (nonmyeloablative chemotherapy, preconditioning) and an arginine producing strain (SYN825, FIG. 40E) or kynurenine consuming strain (SYN2028, FIG. 40F). The effect of the combination treatment was compared to treatment with vehicle alone (FIG. 40B), cyclophosphamide alone (FIG. 40C), or SYN94 (streptomycin resistant wild type Nissle, FIG. 40D). The data suggest anti-tumor activity of the arginine producing and the kynurenine-consuming strains in combination with cyclophosphamide. In this study, BALB/c mice were implanted with CT26 tumors; cyclophosphamide (CP) was administered IP at 100 mg/kg; bacteria were administered intratumorally at $1 \times 10^{e7}$ (in a 100 ul volume). The administration schema is shown in FIG. 40A.
Figure 40C:
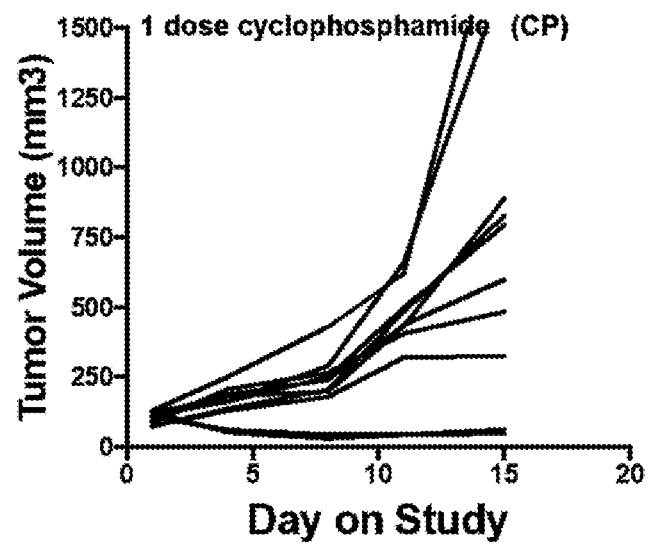
Figure 40D:
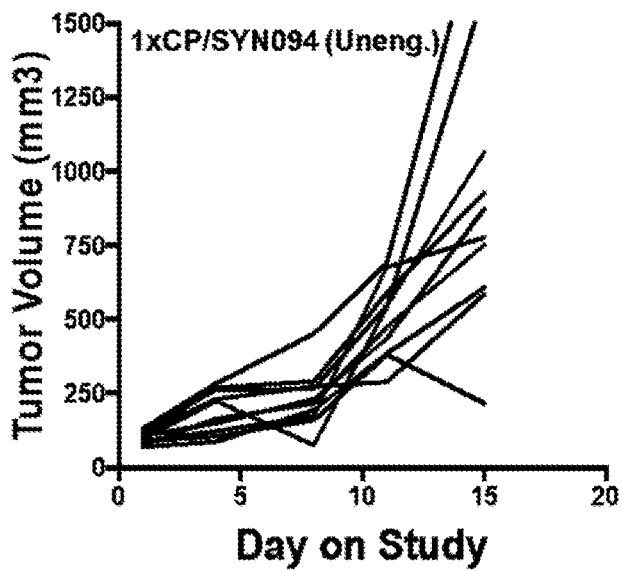
Figure 40E:
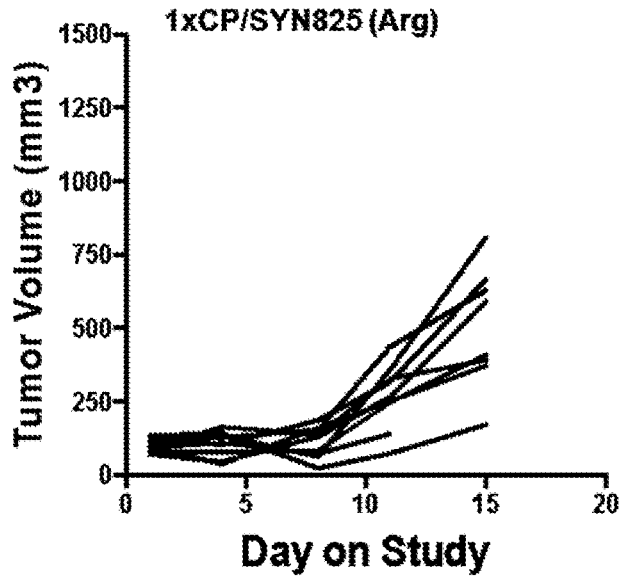
Figure 40F:
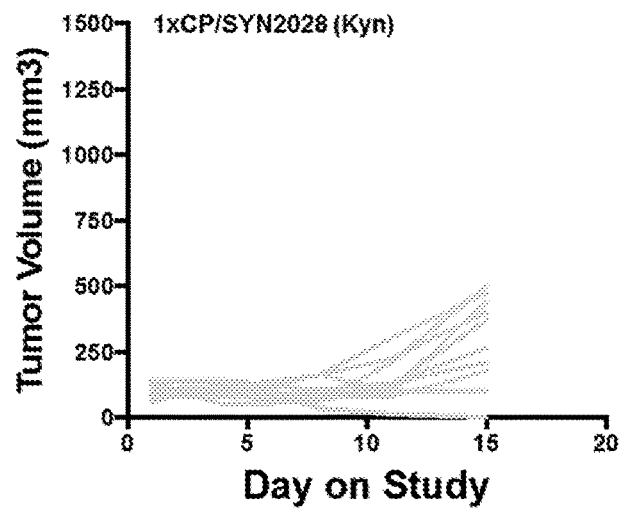
Figure 41:
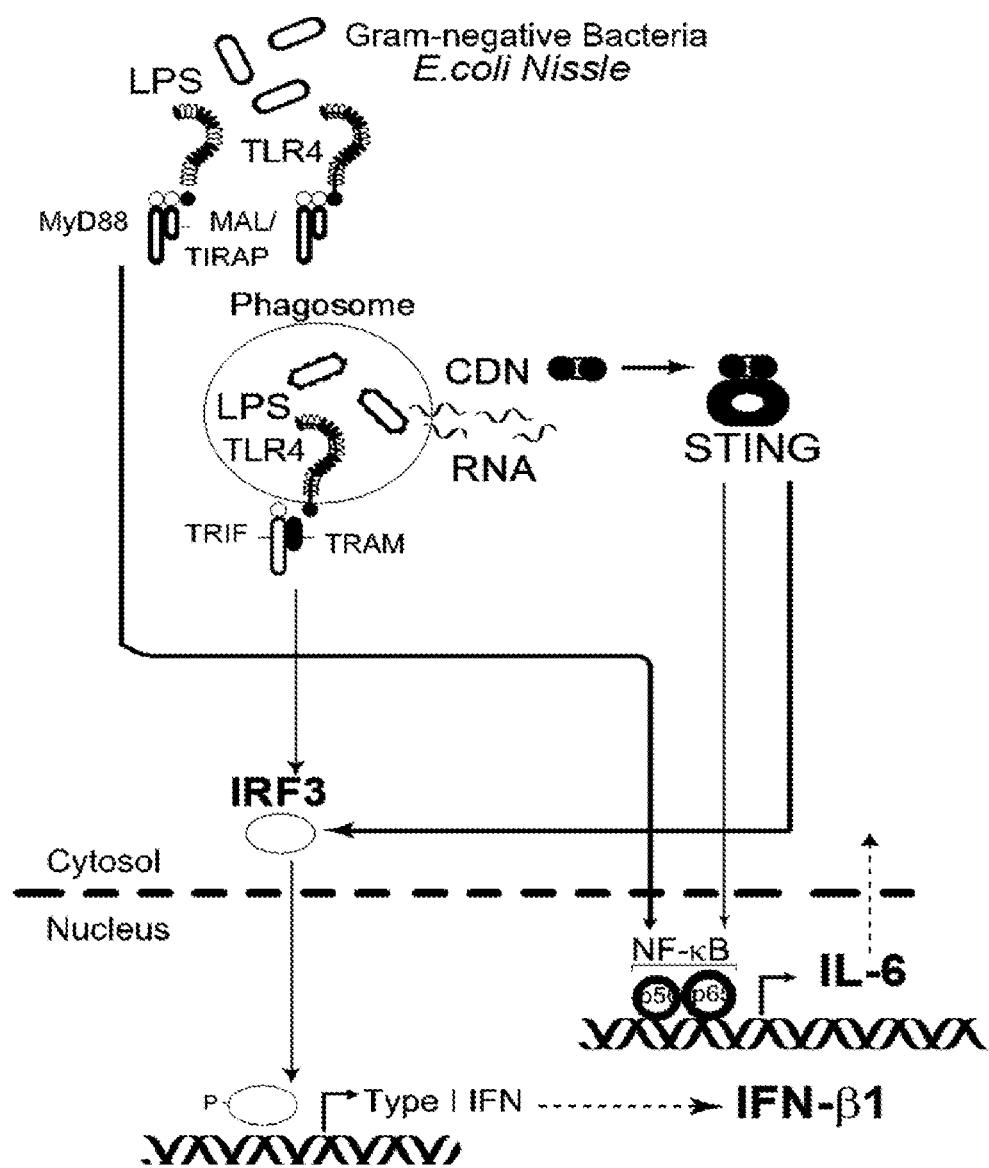
FIG. 41 depicts a schematic showing the STING Pathway in Antigen Presenting Cells.

Mice were implanted with CT26 tumors, and mice injected intratumorally with bacteria producing arginine (SYN828) and consuming kynurenine (SYN2028) and controls in combination with cyclophosphamide (CP) at 100 mg/kg, according to the time line described below and in FIG. 40A.

Briefly, CT26 cells were implanted (1e6 cells/mouse in PBS) SC into the right flank of each animal on day −9. Tumor growth was monitored until the tumors reached ~50-80 mm^3. On day 0, mice were pre-treated with cyclophosphamide at 100 mg/kg (100 uL/mouse) I.P. and randomized into groups. On Day 1 of treatment mice received either SYN94 (WT, 1e8 CFU/mL) (I.T.), SYN2028 (Kyn, 1e8 CFU/mL), or SYN825 (Arg, 1e8 CFU/mL) (I.T.) in 100 uL. On Day 4, 8, 11, and 15, animals were weighed, tumor was measured, and mice were dosed mice with the appropriate treatment/group. Tumor volumes for individual mice are shown in FIGS. 40B, 40C, 40D, 40E, and 40F. and indicate Anti-tumor activity of the kynurenine-consuming and arginine producing strains in combination with cyclophosphamide over cyclophosphamide alone.

Example 19. Cyclic-Di-AMP Quantitation in Bacterial Cell Pellet and Tumor Tissue Homogenate by LC-MS/MS Sample Preparation To generate the standards, 10 mg/mL of Cyclic-di-AMP was prepared in 1.5 mL microcentrifuge tubes, and 250, 100, 20, 4, 0.8, 0.16, 0.032 μg/mL solutions were prepared in water. QC solutions were prepared with 200, 20, and 2 μg/mL levels.

Sample Preparation: for in vitro samples, bacterial pellet was extracted by adding 100 uL of 2:1 acetonitrile:water, and vortexed and centrifuged. 20 μL of supernatant was transferred to a new 96 well plate and diluted tenfold by adding 180 μL 0.1% formic acid. For in vivo sample, tissue homogenates were extracted by adding 90 μL of 2:1 acetonitrile:water to 10 μL tumor homogenate. Samples were vortexed and centrifuged. 20 μL of supernatant was transferred to a new 96 well plate and diluted tenfold by adding 180 μL 0.1% formic acid. Plates were heat-sealed with a ClearASeal sheet and mixed well.

LC-MS/MS Method

Analytes were measured by liquid chromatography coupled to tandem mass spectrometry (LC-MS/MS) using a Thermo TSQ Quantum Max triple quadrupole mass spectrometer. Table 55-Table 57 provide the summary of the LC-MS/MS method.

TABLE 55

| | |
|---|---|
| Column: | Thermo Accucore aQ C18 2.6 μm (100 × 2.1 mm) |
| Mobile Phase A: | 100% H2O, 0.1% Formic Acid |
| Mobile Phase B: | 100% ACN, 0.1% Formic Acid |
| Injection volume: | 10 μL |

TABLE 56

HPLC Method

| Time (min) | Flow Rate (μL/min) | A % | B % |
|---|---|---|---|
| 0 | 300 | 100 | 0 |
| 0.5 | 300 | 100 | 0 |
| 1.0 | 300 | 10 | 90 |
| 2.5 | 300 | 10 | 90 |
| 2.51 | 300 | 100 | 0 |
| 4.0 | 300 | 100 | 0 |

TABLE 57

Tandem Mass Spectrometry:

| Ion Source: | HESI-II |
|---|---|
| Polarity: | Positive |
| Analyte SRM transitions: | |
| Cyclic-di-AMP: | 659.4 > 329.6 |

For data analysis, SRM chromatograms were integrated and peak areas of the standards were plotted against concentration. A linear curve was fit and concentrations of the unknowns were calculated using their peak areas and the slope intercept form equation from the standard curve.

Example 20. Display of Anti-mPD1-scFv on E coli Nissle Cell Surface

To generate genetically engineered bacteria which are capable of displaying anti-mPD1-scFv on the Nissle cell surface, constructs were generated according to methods described herein as shown in Table 31. Sequences are SEQ ID NO: 987-989. Display anchor polypeptides include SEQ ID NO: 990-992.

TABLE 31

Strains for display of anti-mPD1-scFv

| Strain Number | Strain Genotype | Construct |
|---|---|---|
| SYN2797 | wt Nissle | p15A-Kan-ptet-Invasin-FLAG-J43scFv-V5-HIS |
| SYN2798 | wt Nissle | p15A-Kan-ptet-LppOmpA-FLAG-J43scFv-V5-HIS |
| SYN2799 | wt Nissle | p15A-Kan-ptet-IntiminN-FLAG-J43scFv-V5-HIS |

In some embodiments, the display anchor is at least about 80%, at least about 85%, at least about 90%, at least about 95%, or at least about 99% homologous to the sequence of SEQ ID NO: 990, SEQ ID NO: 991, and/or SEQ ID NO: 992.

E. coli Nissle comprising a plasmid based construct comprising tet-inducible ptet-LppOmpA-anti-PD1-scFv was grown overnight in LB medium. Cultures were diluted 1:100 in LB and grown shaking (200 rpm) to an optical density of 0.8 at which time culture was cooled down to room temperature and anhydrous tetracycline (ATC) was added to cultures at a concentration of 100 ng/mL to induce expression of ptet-LppOmpA-J43-scFv for 18 hours.

To determine whether the single-chain antibody was displayed on the surface of the genetically engineered E. coli Nissle and functionally binds to PD1 a whole cell ELISA assay was performed. 10^9 cells were blocked using PBS with 2% BSA for 1 h at room temperature and biotinylated-mPD1 was added and incubated for 1 h at room temperature. Afterwards, cells were washed 3 times with PBST (PBS/0.1% Tween-20) and incubated with a streptavidin conjugated HRP in blocking solution for 40 min. Following incubation, wells were washed 3 times with PBST and resuspended in PBS, then stained using a 3,3',5,5'-tetramethylbenzidine (TMB) substrate kit per the manufacturer's instructions (Thermofisher). Biotinylated IgG and plain PBS were used instead of mPD1 as negative controls. Cells were removed by centrifugation and supernatants were collected. Signal intensities of supernatant were measured using an ELISA reader at 450 nm. Results (data not available) indicate that the J43-scFv (anti-mPD1) is displayed on the surface of the genetically engineered bacteria and can bind to mPD1 (Table 32).

TABLE 32

Nissle Surface Display ELISA Assay

| Strain | OD450 | Primary antibody | Secondary antibody |
|---|---|---|---|
| SYN2798 (p15A-ptet-LppOmpA-anti-PD1-scFv) | 0.125 | PBS only | Strp-HRP |
| SYN2798 (p15A-ptet-LppOmpA-anti-PD1-scFv) | 0.133 | mIgG-strp | Strp-HRP |
| SYN2798 (p15A-ptet-LppOmpA-anti-PD1-scFv) | 0.421 | mPD1-strp | Strp-HRP |

Example 21. a-PD1-scFv Expression in E. coli

To determine whether a functional scFv can be expressed in E coli, an anti-PD1-scFv fragment was generated based on J43 monoclonal antibody, which reacts with mouse PD-1.

Mouse monoclonal antibody J43 sequence was obtained from patent EP 1445264 A1. Next, the single-chain variable fragment (scFv) was designed. A fragment containing tet promoter, a ribosome binding site, the designed J43-scFv, a C terminal V5 tag and a C terminal hexa-histidine tag (SEQ ID NO: 1252) was synthesized by IDTDNA. The construct was cloned into the pCR™-Blunt II-TOPO® Vector (Invitrogen) and transformed into E. coli DH5α as described herein to generate the plasmid pUC-ptet-J43scFv-V5-HIS (SEQ ID NO: 976-980).

E. coli comprising either tet-inducible J43-Anti-PD1-scFv-V5 or wild type controls were grown overnight in LB medium. Cultures were diluted 1:40 in LB and grown shaking (250 rpm) to an optical density of 0.8 at which time anhydrous tetracycline (ATC) was added to cultures at a concentration of 100 ng/mL to induce expression of J43-Anti-PD1-scFv-V5. Same amount of tetracycline was added to wild type control cultures. After 4 hrs of induction, bacteria were pelleted, washed in PBS, and harvested, resuspended in 2 mL sonication buffer (PBS), and lysed by sonication on ice. Insoluble debris was spun down twice for 15 min at 12,000 rpm at 4.C.

Protein concentration was determined by BCA protein assay, and isolated extracts from wild type and strains comprising the Ptet-J43-Anti-PD1-scFV-V5 were analyzed by Western blot. Proteins were transferred onto PVDF membranes and J43-Anti-PD1-scFv was detected with an HRP-conjugated anti-V5 antibody (Biolegend). A single band was detected at 27 kDa in lane 2 (extract from J43-Anti-PD1-scFv-V5 strain). No bands were detected in lane 1 (wild type extract).

To determine whether the single-chain antibody purified from E. coli DH5α functionally binds to the target protein, PD1, an ELISA assay was performed. Plates were absorbed overnight at 4° C. with 100 µL of 2 µg/mL per well of PD1 (Rndsystems). Wells were blocked with 2% BSA in PBS/0.1% Tween-20 for 2 hours at room temperature. After three washes, wells were incubated with bacterial extracts (J43-scFv-V5 or wild type-neg-ctrl) for 1 hour at room temperature. Wells were washed 4 times with PBST (PBS/0.1% Tween-20) and incubated with a HRP-conjugated anti-V5 antibody (Biolegend) in blocking solution for 40 min. Following incubation, wells were washed 4 times with PBST and then stained using a 3,3',5,5'-tetramethylbenzidine (TMB). Signal intensities were measured using an ELISA reader at 450 nm. Results are shown in Table 77 and indicate that the antibody expressed by the genetically engineered bacteria can bind to PD1 specifically.

TABLE 77

ELISA Binding Assay

| 1' antibody | PBS coating | mPD1 coating | IgG coating | 2' antibody |
|---|---|---|---|---|
| Wild type-neg-ctrl | 0.11 | 0.13 | 0.12 | α-V5-HRP |
| J43-scFv-V5 | 0.11 | 1.41 | 0.13 | α-V5-HRP |
| Wild type-neg-ctrl (1/2) | 0.10 | 0.09 | 0.10 | α-V5-HRP |
| J43-scFv-V5 (1/2) | 0.10 | 0.90 | 0.11 | α-V5-HRP |

Next, recombinant J43-Anti-scFv-V5 was expression using pET22b vector harvesting a C-terminal poly-histidine tag and purified using immobilized metal ion affinity chromatography. Protein concentration was determined by absorption at 280 nm and purity was confirmed by Coomassie gel (data not shown).

To determine whether anti-PD1-scFv expressed in E. coli binds to surface PD1 on mouse EL4 cells, flow cytometric analysis was performed using EL4 cells. EL4 are a mouse lymphoma cell line which expresses PD1 on its cell surface.

Figure 18:
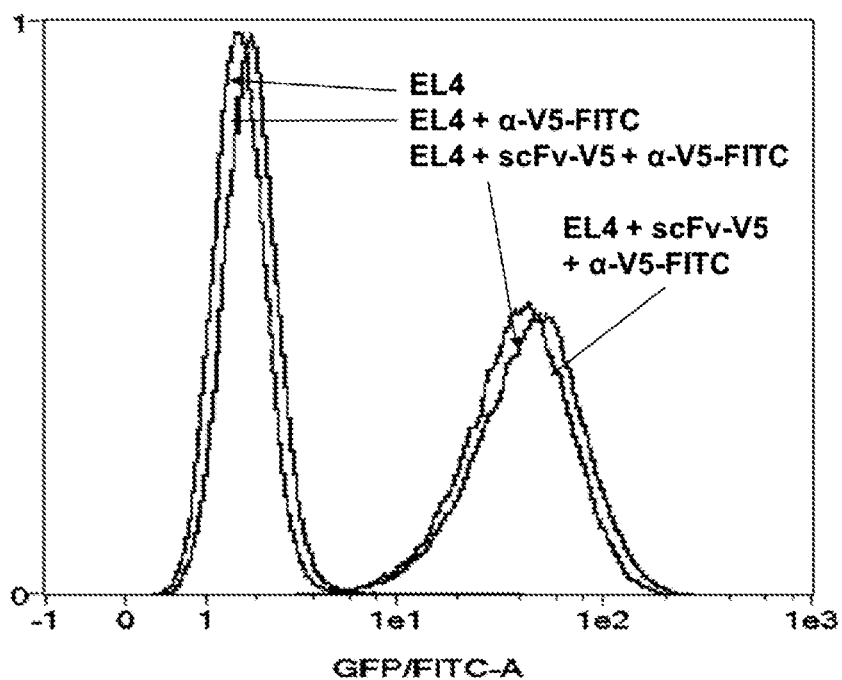
FIG. 18 depicts a diagram of a flow cytometric analysis of PD1 expressing EL4 cells which were incubated with extracts from a strain expressing tet inducible anti-PD1-scFv, and showing that anti-PD1-scFv expressed in *E. coli* binds to PD1 on mouse EL4 cells.

EL4 cells were grown in Dulbecco's Modified Eagle's Medium (DMEM) with 10% FBS. Cells were spun down, supernatant was aspirated, pellet was resuspended in 1 ml D-PBS, transferred into chilled assay tubes (1×106 cells), and washed 2-3 times in D-PBS with 0.5% BSA. Cells were resuspended in PBS with 0.5% BSA, to which the purified scFv-V5 and anti-V5-FITC antibody were added and incubated for 1 hour at room temperature. Negative control left out scFv-V5. Cells were resuspended in 0.5 ml PBS and analyzed on a flow cytometer. Results are shown in FIG. 18. A population shift is observed only when the purified anti-PD1-scFv-V5 and anti-V5-FITC were both present (two different batches were shown), relative to samples with EL4 alone and EL4 plus secondary antibody only.

Example 22. Secretion of Anti-mPD1-scFv

Strains generated according to methods described herein for secretion of anti-mPD1-scFv are shown in Table 30.

TABLE 30

Strains for secretion of anti-mPD1-scFv

| Strain Number | Genotype | Construct |
|---|---|---|
| SYN2790 | Nissle delta nlpI::CmR | pUC-ptet-OmpF-FLAG- |
| SYN2767 | Nissle delta tolA::CmR | pUC-ptet-OmpF-FLAG- |
| SYN2768 | Nissle delta PAL::CmR | pUC-ptet-OmpF-FLAG- |
| SYN2769 | Nissle delta lpp::CmR | pUC-ptet-OmpF-FLAG- |
| SYN2770 | Nissle delta nlpI::CmR | pUC-ptet-PhoA-FLAG- |
| SYN2771 | Nissle delta tolA::CmR | pUC-ptet-PhoA-FLAG- |
| SYN2772 | Nissle delta PAL::CmR | pUC-ptet-PhoA-FLAG- |
| SYN2773 | Nissle delta lpp::CmR | pUC-ptet-PhoA-FLAG- |
| SYN2774 | Nissle delta nlpI::CmR | pUC-ptet-PelB-FLAG- |
| SYN2775 | Nissle delta tolA::CmR | pUC-ptet-PelB-FLAG- |
| SYN2776 | Nissle delta PAL::CmR | pUC-ptet-PelB-FLAG- |
| SYN2777 | Nissle delta lpp::CmR | pUC-ptet-PelB-FLAG- |

E. coli Nissle comprising plasmid based construct comprising tet-inducible J43-Anti-scFv-V5 with PhoA, OmpF or PelB secretion tags (see SEQ ID NO: 981-986) or wild type control were grown overnight in LB medium. Cultures were diluted 1:100 in LB and grown shaking (200 rpm) to an optical density of 0.8 at which time cultures were cooled down to room temperature and anhydrous tetracycline (ATC) was added to cultures at a concentration of 100 ng/mL to induce expression of PhoA-, OmpF- or PelB-J43-Anti-scFv-V5. No tetracycline was added to wild type Nissle cultures. After 18 hrs of induction at room temperature, bacteria were pelleted, and the supernatant was collected and placed on ice.

Figure 19:
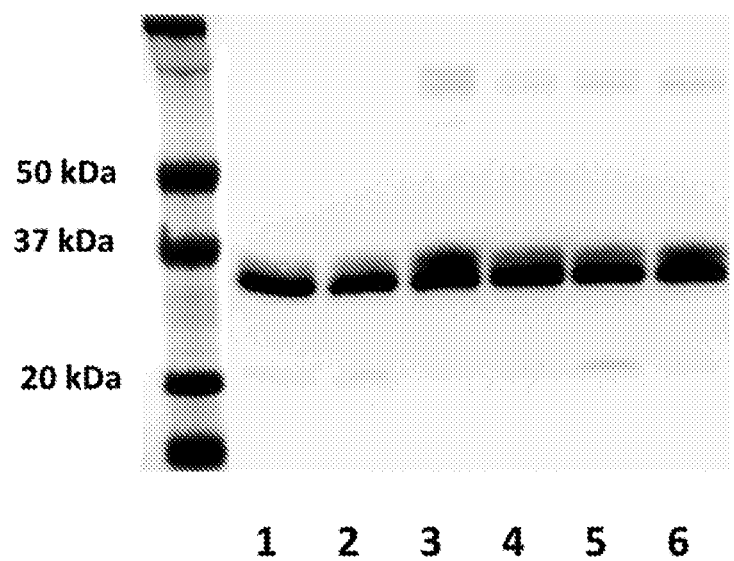
FIG. 19 depicts a Western Blot analysis of total cytosolic extracts of various strain secreting anti-PD1 scFv. A single band was detected around 34 kDa in lane 1-6 corresponding to extracts from SYN2767, SYN2769, SYN2771, SYN2773, SYN2775 and SYN2777, respectively.

Protein concentration in the medium and the cell lysates was determined by BCA protein assay, and isolated extracts and media from wild type and strains comprising the Ptet-J43-anti-scFv-V5 were analyzed by Western blot. Proteins were transferred onto PVDF membranes and J43-anti-scFv detected with an HRP-conjugated anti-V5 antibody (Biolegend). Results are shown in FIG. 19. A single band was detected around 34 kDa in lane 1-6 corresponding to extracts from SYN2767, SYN2769, SYN2771, SYN2773, SYN2775 and SYN2777 respectively.

To determine whether the secreted J43-anti-scFv in E coli Nissle binds to PD1 on mouse cells, flow cytometric analysis was performed using EL4 cells. EL4 are a mouse lymphoma cell line which expresses PD1 on its cell surface.

Figure 20:
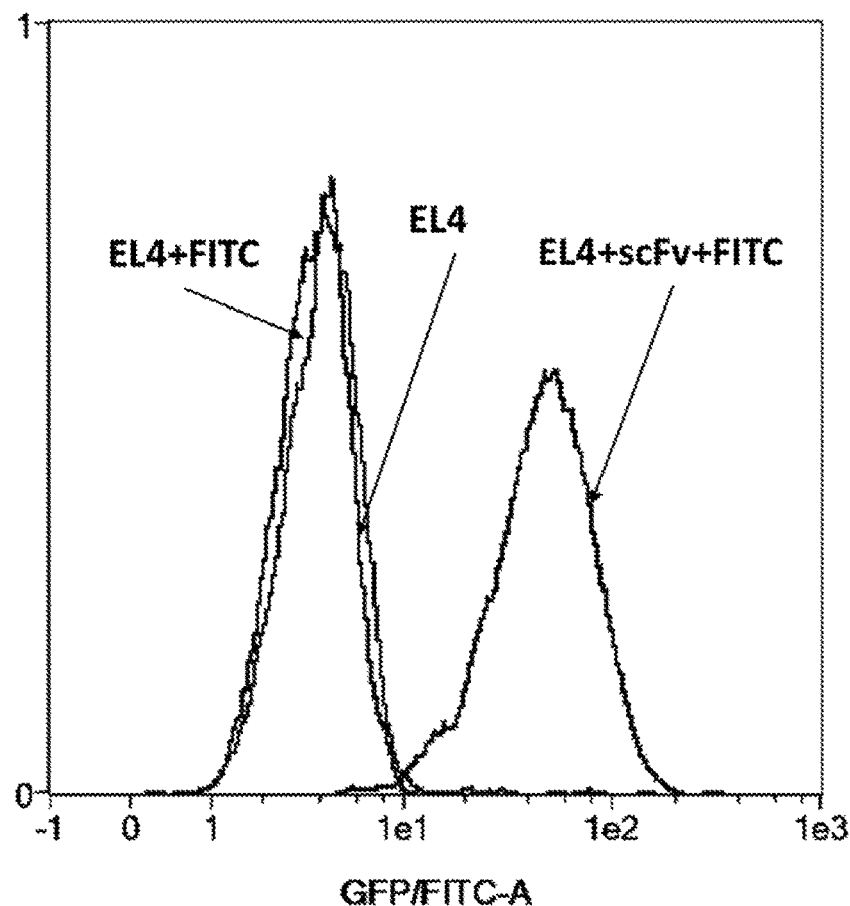
FIG. 20 depicts a diagram of a flow cytometric analysis of PD1 expressing EL4 cells, which were incubated with extracts from a *E coli* Nissle strain secreting tet-inducible anti-PD1-scFv, showing that anti-PD1-scFv secreted from *E. coli* Nissle binds to PD1 on mouse EL4 cells.
Figure 21:
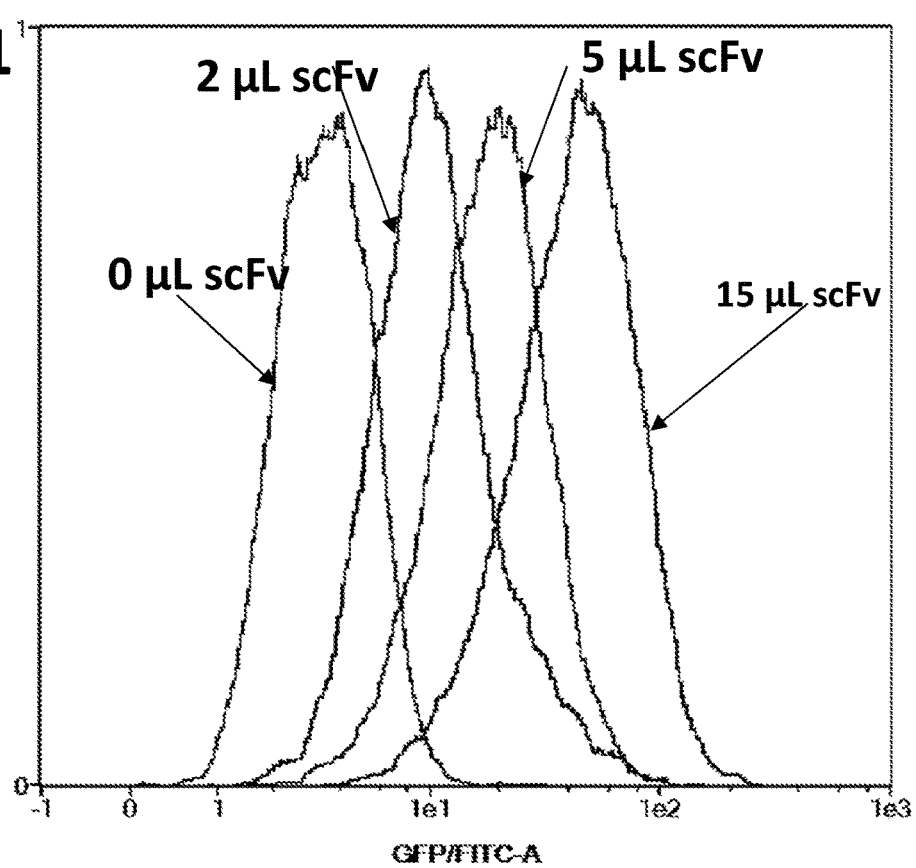
FIG. 21 depicts a diagram of a flow cytometric analysis of PD1 expressing EL4 cells, which were incubated with various amounts of extracts (0, 2, 5, and 15 ul) from an *E. coli* Nissle strain secreting tet-inducible anti-PD1-scFv, showing that anti-PD1-scFv secreted from *E. coli* Nissle binds to PD1 on mouse EL4 cells, in a dose dependent manner.

EL4 cells were grown in Dulbecco's Modified Eagle's Medium (DMEM) with 10% FBS and 1% Penicillin-Streptomycin Cells were spun down, supernatant was aspirated, pellet was resuspended in 1 ml D-PBS, transferred into chilled assay tubes (1×10^6 cells), and washed 3 times in D-PBS. Cells were resuspended in D-PBS with 0.5% BSA, to which the purified scFv-V5 and anti-V5-FITC antibody were added and incubated for 1 hour at room temperature. Negative control left out secreted J43-scFv-V5. Cells were then resuspended in 0.5 ml PBS and analyzed on a flow cytometer. Results are shown in (FIG. 20). A population shift is observed only when the secreted anti-PD1-scFv-V5 (1' antibody) and anti-V5-FITC (2' antibody) were both present, relative to samples with EL4 alone and EL4 plus secondary antibody only. A similar study was conducted with different amounts of the secreted scFv (0, 2, 5, and 15 μL), and a dose-dependent staining of the EL4 cells was observed (FIG. 21).

Figure 22A:
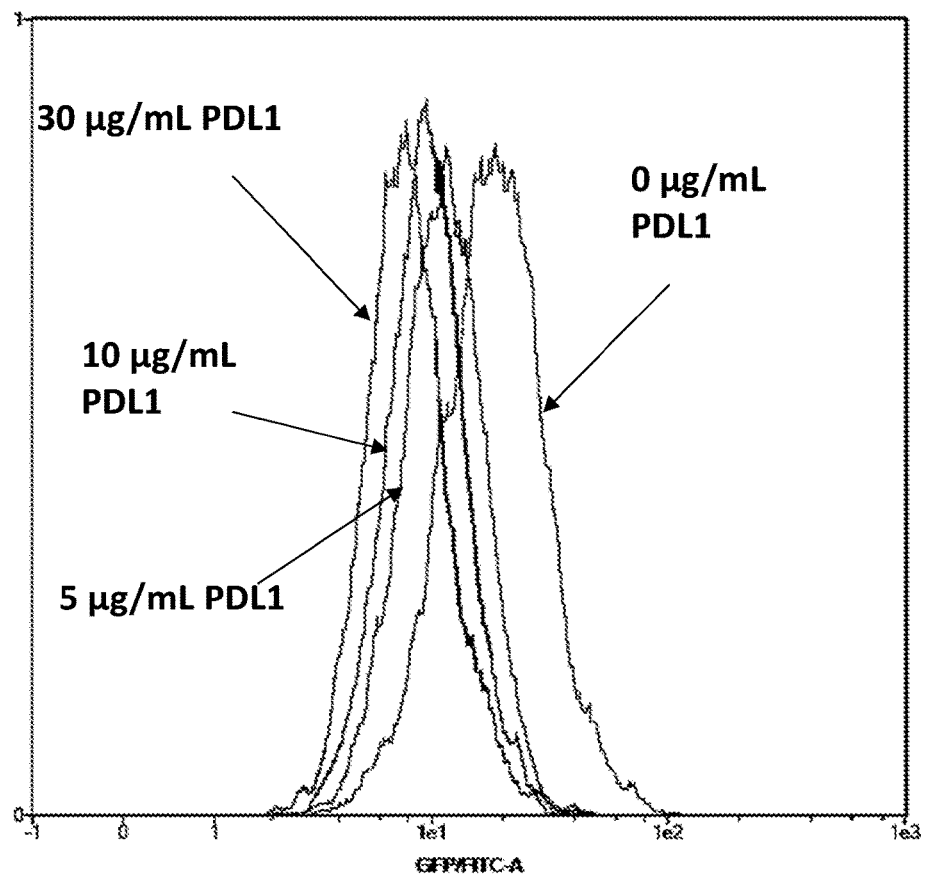
FIGS. 22A and 22B depicts diagrams of a flow cytometric analysis of EL4 cells.
Figure 22B:
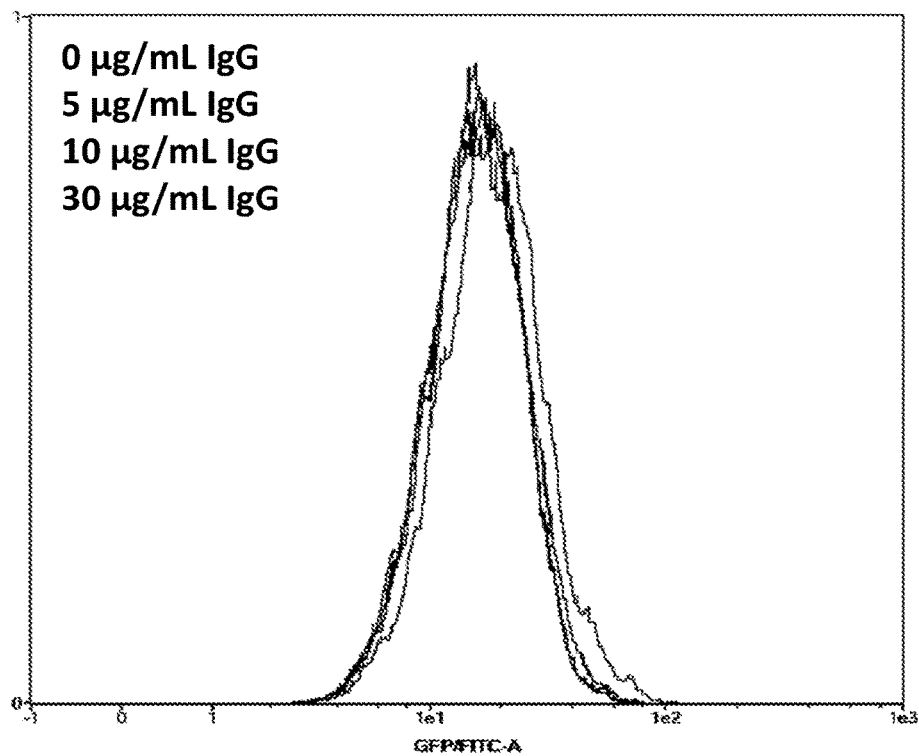
Figure 23A:
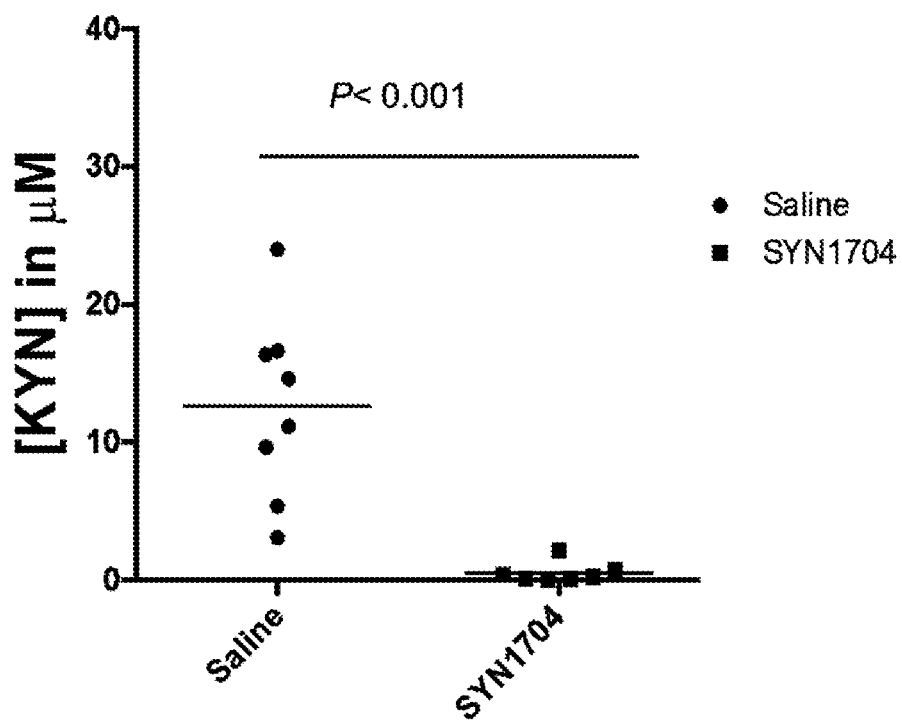
FIG. 23A-FIG. 23D, depict dot plots showing concentrations of intratumoral kynurenine (FIG. 23A) and plasma kynurenine (FIG. 23C) measured in mice administered either saline, or SYN1704. A significant reduction in intratumoral (P<0.001) and plasma (P<0.005) concentration of kynurenine was observed for the kynurenine consuming strain SYN1704 compared to saline control. Tryptophan levels remained constant (data not shown).
Figure 23B:
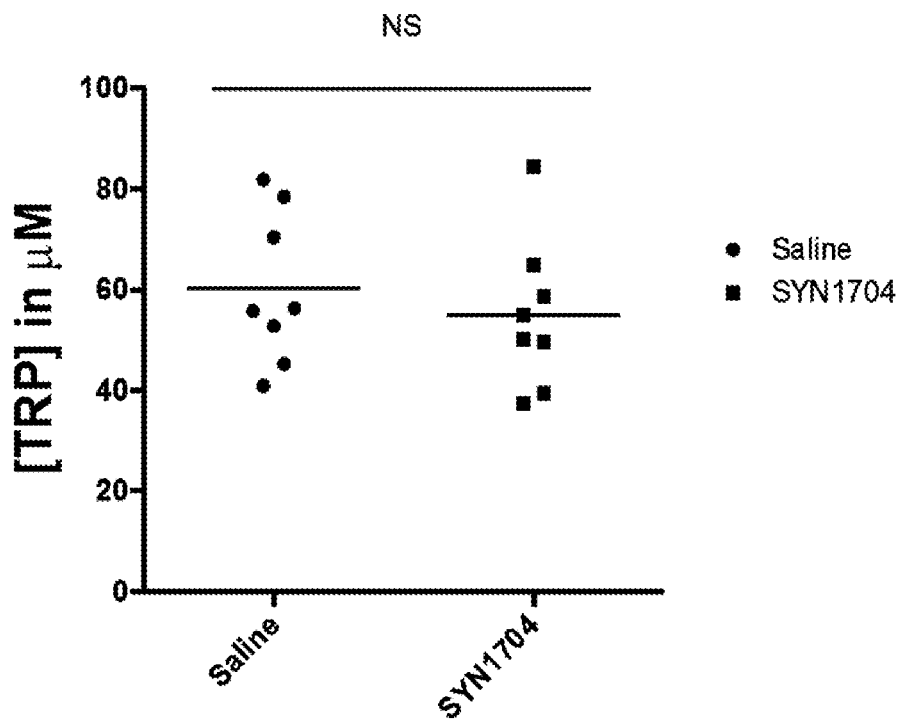
Figure 23C:
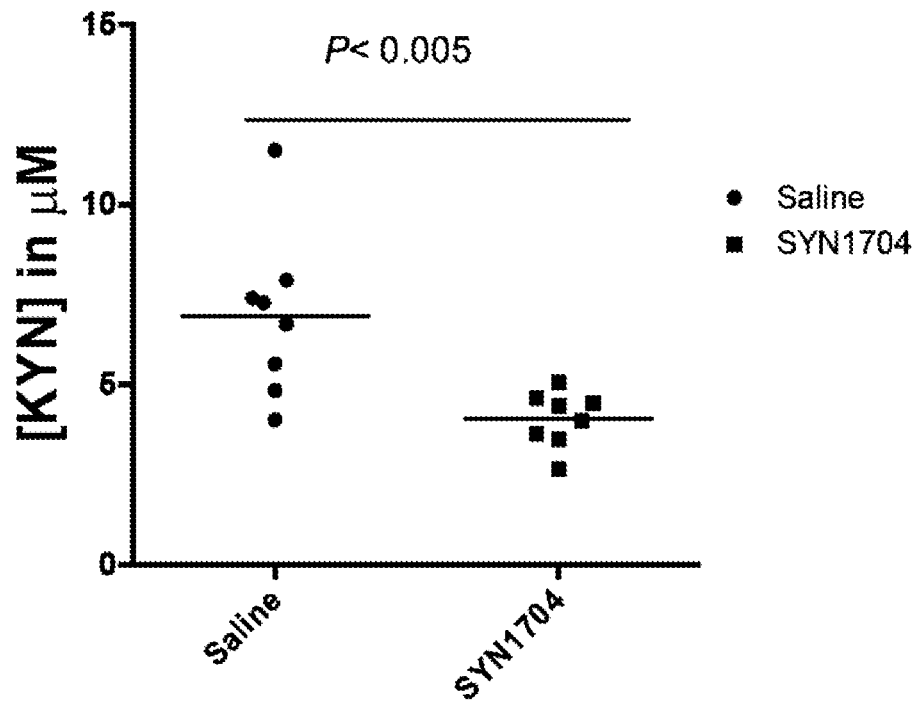
Figure 23D:
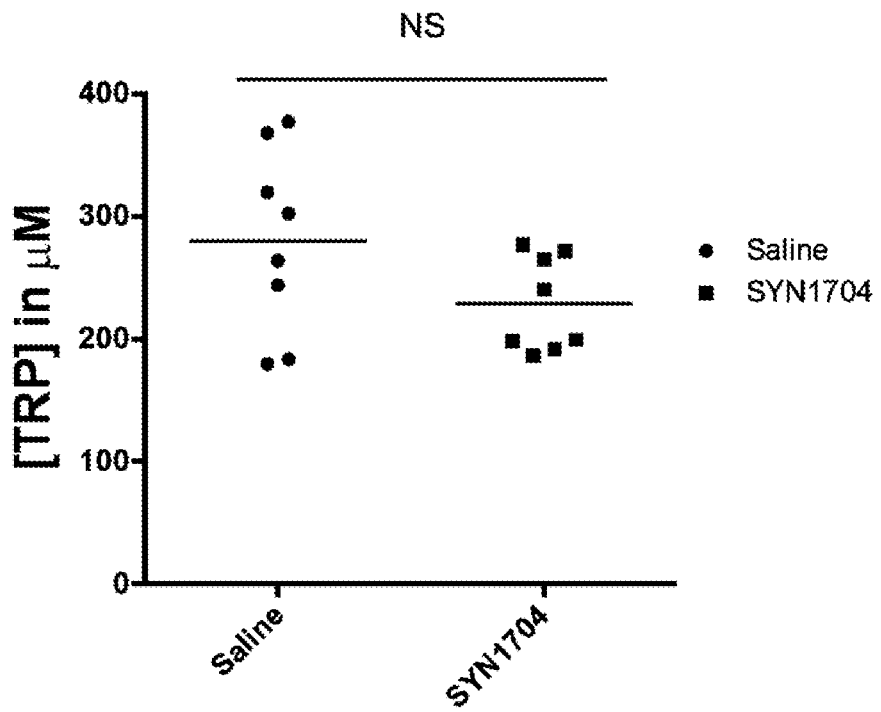
Figure 24A:
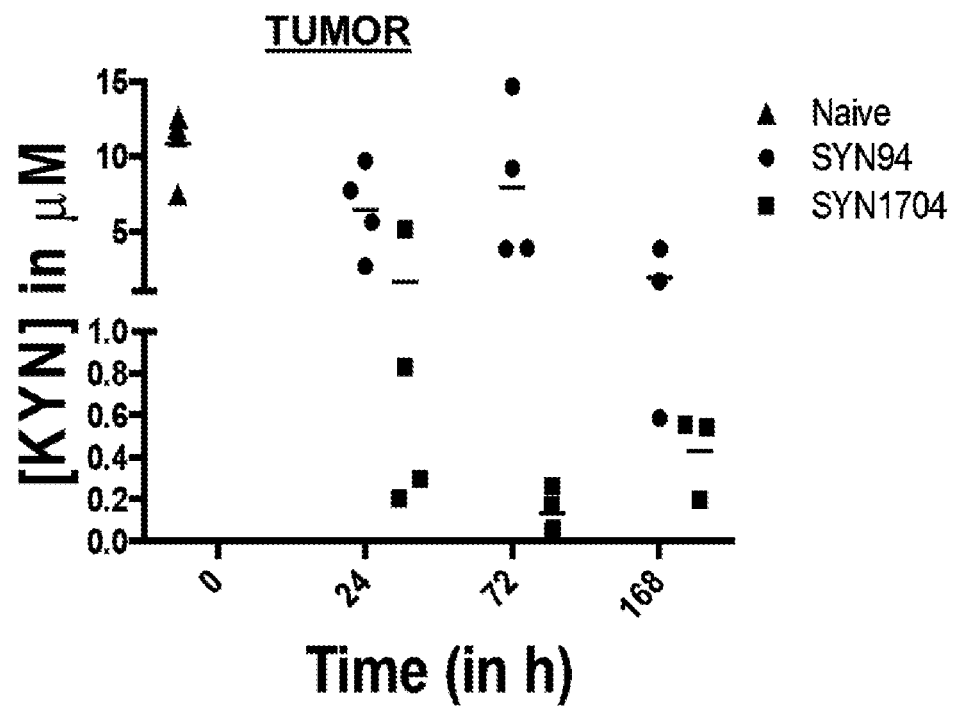
FIGS. 24A, 24B, and 24C depict graphs showing the effects of single administration of a KYN-consuming strain in CT26 tumors has on tumoral KYN levels in the tumor (FIG. 24A) and plasma (FIG. 24B), and tumor weight (FIG. 24C). Mice were dosed with SYN94 or SYN1704 at the 1e8 CFU/mL via intratumoral dosing. Animals were sacrificed and blood and tissue was collected at the indicated times.
Figure 24B:
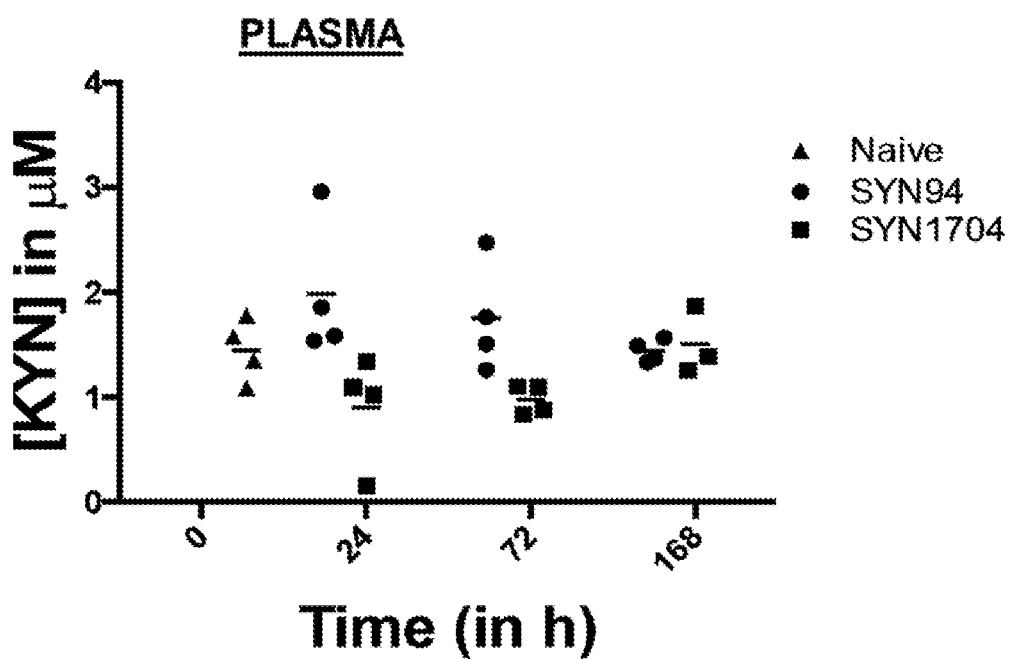
Figure 24C:
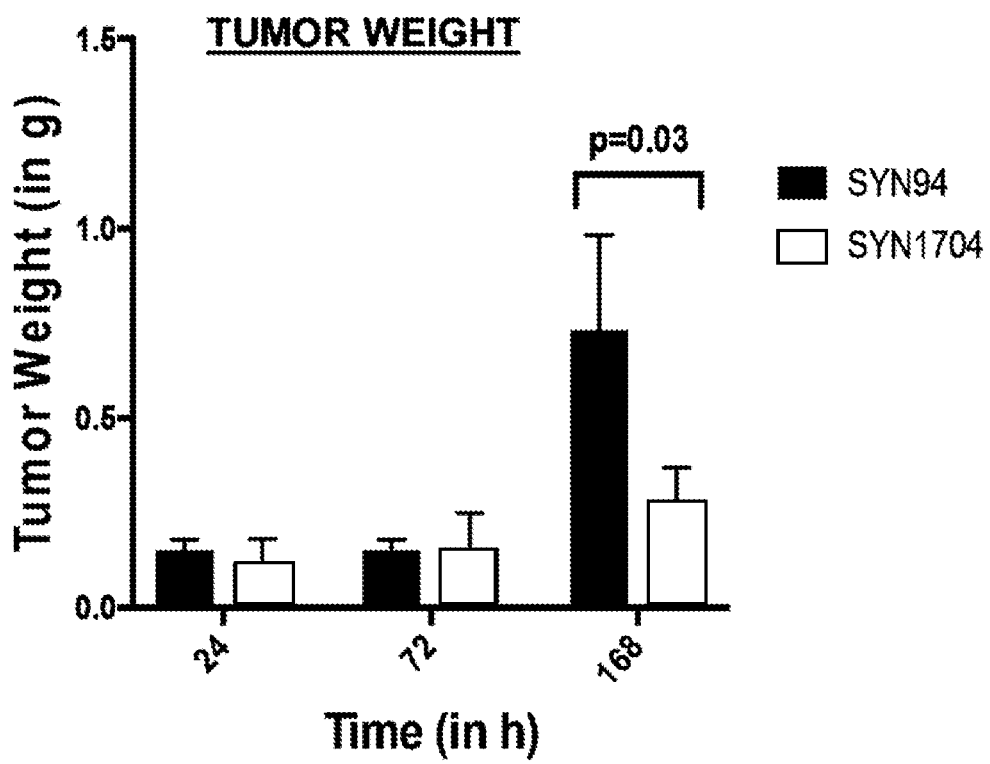

Next, a competition assay was conducted to determine whether PDL1 could inhibit the binding of the anti-PD1-scFv secreted by the genetically engineered bacteria from binding to murine PD1. EL4 cells were grown and flow cytometry protocol was conducted essentially as described above except that PDL1 was added at various concentrations (0, 5, 10, and 30 μg/mL) during the incubation of the secreted anti-PD1-scFv-V5. Rat-IgG was used as a negative control of secreted scFv. Results are shown in FIG. 22A and FIG. 22B. PDL1 competed in a dose dependent manner against the binding of secreted anti-mPD1-scFv to mPD1 on the surface of EL4 cells. Negative control of Rat-IgG protein did not show similar dose dependent binding competition.

Example 23. Cytokine Secretion (IL-15)

To determine whether the hIL-15 expressed by engineered bacteria is secreted, the concentration of hIL-15 in the bacterial supernatant from engineered strains comprising hIL-15 secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hIL-15 with a PhoA secretion tag.

E. coli Nissle strains were grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-15. After 12 hours of induction, cells were spun down, and supernatant was collected. To generate cell free medium, the clarified supernatant was further filtered through a 0.22 micron filter to remove any remaining bacteria and placed on ice. Additionally, to detect intracellular recombinant protein production, pelleted were bacteria washed and resuspended in Bug-Buster™ (Millipore) with protease inhibitors and Ready-Lyse Lysozyme Solution (Epicenter), resulting in lysate concentrated 10-fold compared to original culture conditions. After incubation at room temperature for 10 minutes insoluble debris is spun down at 20 min at 12,000 rcf at 4.0 then placed on ice until further processing.

The concentration of hIL-15 in the cell-free medium and in the bacterial cell extract was measured by hIL-15 ELISA (RnD Systems, Minneapolis, Minn.), according to manufacturer's instructions. All samples were run in triplicate, and a standard curve was used to calculate secreted levels of hIL-15. Standard curves were generated using recombinant hIL-15. Wild type Nissle was included in the ELISA as a negative control, and no signal was observed. Table 25 summarizes levels of hIL-15 measured in the respective supernatants. The data show that hIL-15 is secreted at various levels from the different bacterial strains.

TABLE 25

Concentration of Secreted hIL-15

| ID | Genotype | Construct | [IL-15] (ng/ml) in the medium |
|---|---|---|---|
| SYN1817 | Lpp (lpp::Cm) | pBR322.Ptet.phoA-IL15 | 27.9 |
| SYN1818 | nlpI (nlpI::Cm) | pBR322.Ptet.phoA-IL15 | 30.4 |
| SYN1819 | tolA (tolA::Cm) | pBR322.Ptet.phoA-IL15 | 33.8 |
| SYN1820 | PAL (PAL::Cm) | pBR322.Ptet.phoA-IL15 | 38.0 |

Example 24. Cytokine Secretion (GMCSF)

To determine whether hGMCSF expressed by engineered bacteria is secreted, the concentration of hGMCSF in the bacterial supernatant from engineered strains comprising hGMCSF secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hGMCSF with a PhoA secretion tag.

E. coli Nissle strains were grown, induced and processed as described in the previous example for IL-15.

The concentration of hGMCSF in the cell-free medium and in the bacterial cell extract was measured by hGMCSF ELISA (RnD Systems, Minneapolis, Minn.), according to manufacturer's instructions. All samples were run in triplicate, and a standard curve was used to calculate secreted levels of hGMCSF. Standard curves were generated using recombinant hGMCSF. Wild type Nissle was included in the ELISA as a negative control, and no signal was observed. Table 26 summarizes levels of hGMCSF measured in the respective supernatants. The data show that hGMCSF is secreted at various levels from the different bacterial strains.

TABLE 26

Concentration of Secreted GMCSF

| ID | Genotype | High copy construct | Low copy construct | [GMCSF] (ng/ml) in the medium High copy plasmid | [GMCSF] (ng/ml) in the medium Low copy plasmid |
|---|---|---|---|---|---|
| SYN094 | WT | None | None | 0.0 | 0.0 |
| SYN2036/ SYN2093 | lpp | pUC.Ptet.phoA-GMCSF | pUN UNSX-TetR-Ptet-phoA-GMCSF-UNS9 | 45.8 | 44.7 |
| SYN2038/ SYN2103 | PAL | pUC.Ptet.phoA-GMCSF | pUN UNSX-TetR-Ptet-phoA-GMCSF-UNS9 | 114.3 | 98.8 |
| SYN2037/ SYN2095 | nlpI | pUC.Ptet.phoA-GMCSF | pUN UNSX-TetR-Ptet-phoA-GMCSF-UNS9 | 39.9 | 44.0 |

Example 25. Cytokine Secretion (TNFα)

To determine whether hTNFa expressed by engineered bacteria is secreted, the concentration of hTNFa in the bacterial supernatant from engineered strains comprising hTNFa secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hTNFa with a PhoA secretion tag.

E. coli Nissle strains were grown, induced and processed as described in the previous example for IL-15.

The concentration of hTNFa in the cell-free medium and in the bacterial cell extract was measured by hTNFa ELISA (RnD Systems, Minneapolis, Minn.), according to manufacturer's instructions. All samples were run in triplicate, and a standard curve was used to calculate secreted levels of hTNFa. Standard curves were generated using recombinant hTNFa. Wild type Nissle was included in the ELISA as a negative control, and no signal was observed. Table 27 summarizes levels of hTNFa measured in the respective supernatants. The data show that hTNFa is secreted at various levels from the different bacterial strains.

TABLE 27

Concentration of Secreted TNFa

| Strain | Genotype | Construct | Secreted [TNFa] ng/mL |
|---|---|---|---|
| SYN094 | WT | None | 0 |
| SYN2541 | lpp::Cm | Nissle Ptet-phoA-TNFa | 129.6 |
| SYN2542 | nlpI::Cm | Nissle Ptet-phoA-TNFa | 345.3 |
| SYN2543/ SYN2304 | PAL::Cm | Nissle Ptet-phoA-TNFa | >400 |
| SYN2544 | TrpE PAL::Cm | HA3/4::Plpp-pKYNase Ptet-phoA-TNFa | >400 |
| SYN2545 | TrpE PAL::Cm | HA3/4::PSyn-pKYNase Ptet-phoA-TNFa | >400 |

Example 26. Functional Assay for Secreted TNF-Alpha

Next, studies were conducted to demonstrate that TNF-alpha secreted from genetically engineered bacteria is functional. A cell-based assay was employ based on TNF-alpha mediated NF-kappaB activation. TNF-alpha binding to its receptor binding results in phosphorylation and degradation of IkBalpha by IKK. Bioactivity of TNF-alpha can be determined by quantification of IkB degradation via flow cytometry.

Briefly, HeLa cells were treated with TNFa secreting supernatants derived from SYN2304 (comprising PAL::Cm p15a TetR Ptet-phoA TNFa) for 10 min. Cells were then fixed in paraformaldehyde based buffer followed by permeabilization in Triton X-100. Modulation of IkBa degradation determined by flow cytometry, and results are shown in FIG. 56.

Figure 56:
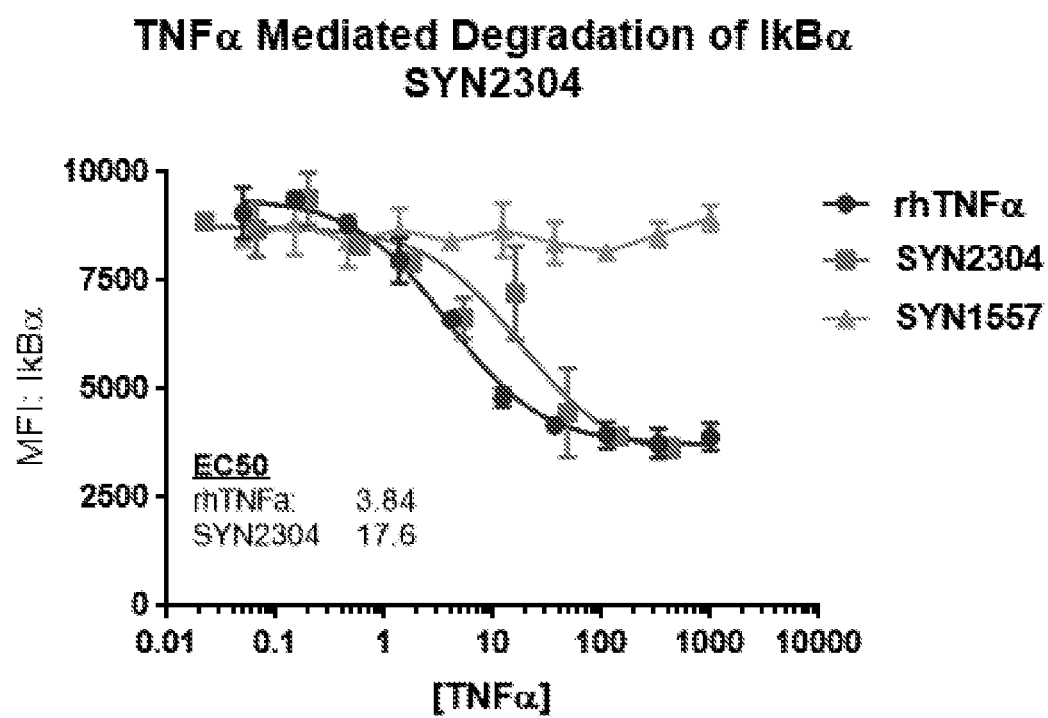
FIG. 56 depicts a graph showing results of a cell based assay showing IkappaBalpha degradation in HeLa cells upon treatment with supernatants of the TNFalpha secreter SYN2304 (PAL::Cm p15a TetR Ptet-phoA TNFa), the parental control SYN1557, and a recombinant IL-15 control.

As seen in FIG. 56, SYN2304 exhibits bioactivity approaching that of rhTNFa, and SYN1557 treatment does not result in measurable signal indicating no confounds from off target components of bacterial supernatants (ie LPS).

Example 27. Cytokine Secretion (hIFNg)

To determine whether hIFNg expressed by engineered bacteria is secreted, the concentration of hIFNg in the bacterial supernatant from engineered strains comprising hTNFa secretion constructs/strains was measured. The strains comprise either a deletion in Lpp (lpp::Cm), nlpI (nlpI::Cm), tolA (tolA::Cm), or PAL (PAL::Cm). All strains further comprise a plasmid expressing hIFNg with a PhoA secretion tag.

E. coli Nissle strains were grown, induced and processed as described in the previous example for IL-15.

The concentration of hIFNg in the cell-free medium and in the bacterial cell extract was measured by hIFNg ELISA (RnD Systems, Minneapolis, Minn.), according to manufacturer's instructions. All samples were run in triplicate, and a standard curve was used to calculate secreted levels of hIFNg. Standard curves were generated using recombinant hIFNg. Wild type Nissle was included in the ELISA as a negative control, and no signal was observed. Table 28 summarizes levels of hIFNg measured in the respective supernatants. The data show that hIFNg is secreted at various levels from the different bacterial strains.

TABLE 28

Concentration of Secreted IFNg

| Strain | Genotype | Construct | Secreted [IFNg] ng/mL |
|---|---|---|---|
| SYN094 | WT | None | 0 |
| SYN2546 | lpp::Cm | Nissle Ptet-phoA-IFNg | 44.9 |
| SYN2547 | nlpI::Cm | Nissle Ptet-phoA-IFNg | 51.5 |
| SYN2548 | PAL::Cm | Nissle Ptet-phoA-IFNg | 85.9 |
| SYN2549 | TrpE PAL::Cm | HA3/4::Plpp-pKYNase Ptet-phoA-IFNg | 39.1 |
| SYN2550 | TrpE PAL::Cm | HA3/4::PSyn-pKYNase Ptet-phoA-IFNg | 87.6 |

Table 29 provides a summary of the levels of secretion obtained for each cytokine, and lists some structural features of the cytokine which may explain some of the differences in secretion levels observed.

TABLE 29

Summary of Secretion Results

| Therapeutic | Size (Dal) | Stoichiometry | O-linked Glycosylation | N-linked Glycosylation | Disulphide Bonds | Secretion level (ng/mL) |
|---|---|---|---|---|---|---|
| hIL-15 | 14715 | Monomer | 0 | 1 | 2 | 38.0 |
| GMCSF | 14477 | Monomer | 4 | 2 | 2 | 114.0 |
| TNF-alpha | 17353 | Monomer | 1 | 0 | 1 | >400 |
| IFN-gamma | 16177 | Homodimer | 0 | 2 | 0 | 87.6 |

Example 28. Anti-CD47 scFv Expression in E. coli

To determine whether a functional anti-CD47-scFv can be expressed in E. coli, an anti-CD47-scFv fragment was generated based on B6H12 and 5F9 monoclonal antibodies, which reacts with human CD47.

Monoclonal antibody B6H12 and 5F9 (anti human CD47) sequences were obtained from published patent (US 20130142786 A1). Next, the single-chain variable fragment (scFv) targeting human CD47 was designed. A fragment containing tet promoter, a ribosome binding site, the designed antihCD47-scFv, a C terminal V5 tag and a C terminal hexa-histidine tag (SEQ ID NO: 1252) was synthesized by IDTDNA. The construct was cloned into the pCR™-Blunt II-TOPO® Vector (Invitrogen) and transformed into E. coli DH5a as described herein to generate the plasmid pUC-ptet-B6H12antihCD47scFv-V5-HIS (SEQ ID NO: 993) and pUC-ptet-5F9antihCD47scFv-V5-HIS (SEQ ID NO: 994).

E. coli DH5a comprising pUC-ptet-B6H12antihCD47scFv-V5-HIS or pUC-ptet-5F9antihCD47scFv-V5-HIS were grown overnight in LB medium. Cultures were diluted 1:100 in LB and grown shaking (200 rpm) to an optical density of 0.8 at which time cultures were cooled down to room temperature and anhydrous tetracycline (ATC) was added to cultures at a concentration of 100 ng/mL to induce expression of ptet-scFv for 18 hours and then bacteria were pelleted, washed in PBS, and harvested, resuspended in 2 mL PBS buffer and lysed by sonication on ice. Insoluble debris is spun down twice for 15 min at 12,000 rpm at 4.C.

To determine whether the anti CD47 single-chain antibody expressed in E. coli DH5a functionally binds to the target protein, an ELISA assay was performed. Plates were absorbed overnight at 4° C. with 100 µL of 2, ug/mL per well of target proteins (humanCD47, mouseCD47, IgG and PBS, from Rndsystems). Wells were blocked with 2% BSA in PBS/0.1% Tween-20 for 2 hours at room temperature. After three washes, wells were incubated with bacterial extracts for 1 hour at room temperature. Wells were washed 4 times with PBST (PBS/0.1% Tween-20) and incubated with a HRP-conjugated anti-V5 antibody (Biolegend) in blocking solution for 40 min. Following incubation, wells were washed 4 times with PBST and then stained using a 3,3',5, 5'-tetramethylbenzidine (TMB). Signal intensities were measured using an ELISA reader at 450 nm. Results are shown in Table 33 and indicate that the antiCD47-scFv expressed by the genetically engineered bacteria can bind to humanCD47 specifically.

TABLE 33

ELISA Binding Assay

| Strain | Coating | Primary antibody | Secondary antibody | OD450 |
|---|---|---|---|---|
| SYN2936 (pUC-Ptet-B6H12scFv-V5-HIS) | PBS | B6H12-scFv extracts | Anti-V5-HRP | 0.047 |
| SYN2936 (pUC-Ptet-B6H12scFv-V5-HIS) | IgG | B6H12-scFv extracts | Anti-V5-HRP | 0.064 |
| SYN2936 (pUC-Ptet-B6H12scFv-V5-HIS) | hCD47 | B6H12-scFv extracts | Anti-V5-HRP | 1.587 |
| SYN2936 (pUC-Ptet-B6H12scFv-V5-HIS) | mCD47 | B6H12-scFv extracts | Anti-V5-HRP | 0.053 |
| SYN2937 (pUC-Ptet-5F9scFv-V5-HIS) | PBS | 5F9-scFv extracts | Anti-V5-HRP | 0.048 |
| SYN2937 (pUC-Ptet-5F9scFv-V5-HIS) | IgG | 5F9-scFv extracts | Anti-V5-HRP | 0.057 |
| SYN2937 (pUC-Ptet-5F9scFv-V5-HIS) | hCD47 | 5F9-scFv extracts | Anti-V5-HRP | 1.838 |
| SYN2937 (pUC-Ptet-5F9scFv-V5-HIS) | mCD47 | 5F9-scFv extracts | Anti-V5-HRP | 0.053 |

Example 29. Kynurenine Consuming Strains Decrease Tumoral Kynurenine Levels in the CT26 Murine Tumor Model The ability of genetically engineered bacteria comprising kynureninase from *Pseudomonas fluorescens* to consume kynurenine in vivo in the tumor environment was assessed. SYN1704, an *E. coli* Nissle strain comprising a deletion in Trp:E and a medium copy plasmid expressing kynureninase from *Pseudomonas fluorescens* under control of a constitutive promoter (Nissle delta TrpE::CmR+Pconstitutive-*Pseudomonas* KYNU KanR) was used.

In both studies, CT26 cells obtained from ATCC were cultured according to guidelines provided. Approximately ~1×10$^6$ cells/mouse in PBS were implanted subcutaneously into the right flank of each animal (BalbC/J (female, 8 weeks)), and tumor growth was monitored for approximately 10 days. When the tumors reached about ~100-150 mm$^3$, animals were randomized into groups for dosing.

For intratumoral injection, bacteria were grown in LB broth until reaching an absorbance at 600 nm (A600 nm) of 0.4 (corresponding to 2×10$^8$ colony-forming units (CFU)/mL) and washed twice in PBS. The suspension was diluted in PBS or saline so that 100 uL can be injected at the appropriate doses intratumorally into tumor-bearing mice.

Figure 42A:
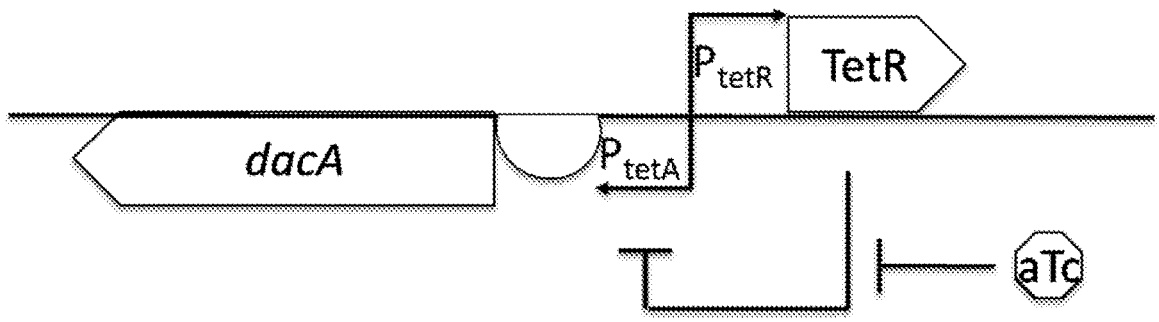
FIG. 42A depicts a schematic showing an exemplary construct for expression of a STING agonist, e.g., as seen in SYN3527. The construct employs dacA, a diadenylate cyclase gene from Listeria monocytogenes. In some embodiments, the construct is introduced into E. coli Nissle. In some embodiments, the construct is located on a plasmid. In some embodiments, the construct is integrated into the bacterial chromosome. In some embodiments, the dacA gene is codon optimized for expression in E. coli Nissle. As shown, expression of dacA may be driven by a tetracycline inducible promoter. Alternatively, a different inducible promoter, known in the art or described herein may be used to drive expression of dacA. In yet other alternative embodiments, a constitutive promoter known in the art or described herein may be used to drive expression of dacA.

Approximately 10 days after CT 26 implantation, bacteria were suspended in 0.1 mL of PBS and mice were injected (1e7 cells/mouse) with 100 uL intratumorally as follows: Group 1-Saline Control (n=7), Group 2-SYN1704 (n=7), Animals were dosed bi-weekly (BIW) according to their grouping either with saline or with the strains intratumorally (IT). Animals were weighed and the tumor volume measured twice weekly. Animals were euthanized when the tumors reached ~2000 mm$^3$. Plasma and tumor tissue were harvested and kynurenine and tryptophan concentrations were measured by LC/MS as described herein. Results are shown in FIGS. 42A and 42C. A significant reduction in intratumoral (P<0.001) and plasma (P<0.005) concentration of kynurenine was observed for the kynurenine consuming strain SYN1704. Tryptophan levels remained constant (data not shown).

Example 30. Kinetic Study with SYN94 and SYN1704 in a CT26 Tumor Model

The effects of single administration of a KYN-consuming strain in CT26 tumors has on tumoral KYN levels and tumor weight was assessed. Female Balb/C mice (18-25 g) from CRL at 8 wks of age were allowed to acclimate to facility for at least 3 days. Animals were being placed on regular food and water.

On day −8, CT26 cells (~1e6 cells/mouse in PBS) were implanted SC into right flank of each animal. Tumor growth was monitored for one week until tumors reached ~100-150 mm3. Animals were then weighed, measured and randomized into treatment groups according to Table 34 (Day 1). Animals were dosed with SYN94 or SYN1704 at the appropriate concentration via intratumoral dosing. For intratumoral injection, SYN94 cells were diluted from a 3.0× 10e11 CFU/mL stock to a concentration of 1×10e8 CFU/mL and SYN1704 cells were diluted from a stock to a concentration of 1×10e8 CFU/mL.

TABLE 34

Study Design

| Group Number | Number of animals/sex | Test Article | Concentration | Dose Volume | Media | Dose Route |
|---|---|---|---|---|---|---|
| 1 | 4/F | None | None | 100 µL | None | None |
| 2 | 4/F | SYN94 | 1e8 CFU/mF | 100 µL | PBS | IT |
| 3 | 4/F | SYN94 | 1e8 CFU/mF | 100 µL | PBS | IT |
| 4 | 4/F | SYN94 | 1e8 CFU/mF | 100 µL | PBS | IT |
| 5 | 4/F | SYN1704 | 1e8 CFU/mF | 100 µL | PBS | IT |
| 6 | 4/F | SYN1704 | 1e8 CFU/mF | 100 µL | PBS | IT |
| 7 | 4/F | SYN1704 | 1e8 CFU/mF | 100 µL | PBS | IT |

Animals were observed daily after dosing for signs of abnormalities or excessive pain associated with tumor growth. Animals were sacrificed on day 1 (T=0 group; Group 1), day 2 (T=24h; Groups 2&5). day 4 (T=72h; Groups 3&6), and day 8 (T=168h; Groups 4&7).

Whole blood was collected for each group via cardiac bleed at appropriate endpoint. Maximum obtainable of blood was collected into LiHep tubes (BD). Samples were kept on ice until they were spun in a centrifuge (2000 g for 10 min at 4 C). Plasma was then transferred into 1.5 mL Eppendorf tubes and stored at −80 C until later analysis. Tumor samples were split into two parts, and the first part was collected at appropriate endpoint in reweighed bead buster tubes. Tissues were weighed in tubes before being stored at −80 C for further analysis. The other part of the tumor was fixed in 10% formalin for sectioning and analysis. Plasma samples from blood collection were analyzed by LCMS and cytokine analysis was conducted using cell based assays. Tumor samples were analyzed by LCMS for kynurenine levels. Results are shown in FIGS. 43A-43C.

Example 31. Secretion of Murine CD40L

To generate genetically engineered bacteria which are capable of secreting CD40L, mCD40L1(47-260) and mCD40L2(122-260) constructs as shown in Table 89 were generated according to methods described herein. mCD40L1(47-260) and mCD40L2(122-260) correspond to extracellular portion of the full length mCD40L and soluble form of mCD4L, respectively. Table 89. Strains for secretion of murine CD40L

| Strain Number | Genotype | Construct |
|---|---|---|
| SYN1557 (parental strain) | Nissle delta PAL::CmR | — |
| SYN3366 | Nissle delta PAL::CmR | pUC-ptet-phoA-mCD40L1 (47-260) -V5-HIS |
| SYN3367 | Nissle delta PAL::CmR | pUC- ptet-phoA-mCD40L2 (112-260) -V5-HIS |

*E. coli* Nissle comprising plasmid-based tet-inducible constructs comprising ptet-PhoA-CD40L1 (47-260) (SYN3366) and tet-PhoA-CD40L2 (112-260) (SYN3367) and the parental control strain SYN1557 were grown overnight in LB medium. Cultures were diluted 1:100 in LB and grown shaking (200 rpm) to an optical density of 0.8, at which time the cultures were cooled down to room temperature and anhydrous tetracycline (ATC) was added to cultures at a concentration of 100 ng/mL to induce expression of mCD40L1 and mCD40L2.

After 18 hours of induction, cells were spun down, and supernatant was collected. To generate cell free medium, the clarified supernatant was further filtered through a 0.22 micron filter to remove any remaining bacteria and placed on ice.

Figure 25:
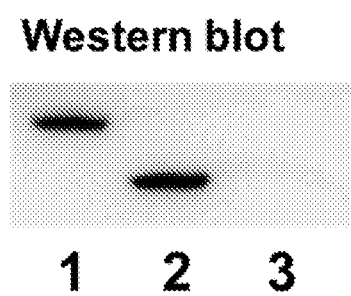
FIG. 25 depicts a Western blot analysis of bacterial supernatants showing murine CD40L1 (47-260) and CD40L2 (112-260) secreted by *E. coli* strains SYN3366 and SYN3367 are detected by a mCD40 antibody.

Supernatants were then analyzed by western blot. Proteins from 25 µL supernatant were transferred onto PVDF membranes and mCD40-L1 and mCD40L-2 were detected with an HRP-conjugated anti-V5 antibody (Biolegend). Results are shown in FIG. 25. A single band was detected around 32 kDa and 24 kDa for mCD40L1 and mCD40L2, respectively.

To determine whether the mCD40L secreted by the genetically engineered *E. coli* Nissle captured in the clarified supernatant can functionally bind to mCD40 and/or is detected by an anti-mCD40L antibody, an ELISA assay was performed by coating the plate with mCD40 or anti-mCD40L antibody. Results are shown in Table 35 and indicate that mCD40L1 (47-260) and mCD40L2 (112-260) secreted by the genetically engineered bacteria and can bind to mCD40.

TABLE 35

CD40 ELISA Binding Assay

| | Coating Materials | | | |
|---|---|---|---|---|
| Samples | mCD40 | Anti-mCD40L | IgG | PBS |
| PBS | 0.051 | 0.063 | 0.049 | 0.047 |
| Control | 0.054 | 0.065 | 0.052 | 0.054 |
| Secreted CD40-L1 | 0.231 | 0.394 | 0.052 | 0.049 |
| Secreted CD40-L2 | 0.639 | 0.825 | 0.052 | 0.05 |

Example 32. Secretion of SIRPα and Variants and Anti-CD47 scFv

To generate genetically engineered bacteria which are capable of secreting anti-SIRPA, constructs shown in Table 36 were generated according to methods described herein. Sequences are shown include SEQ ID NO: 1094-1104 and SEQ ID NO: 1105-1121.

TABLE 36

Strains for secretion of SIRPα, SIRPα variants and mCD47 scFv Ligand

| Strain Number | Genotype | Construct |
|---|---|---|
| SYN1557 (parental | Nissle delta | — |
| SYN2996 | Nissle delta PAL::CmR | p15A-ptet-PhoA-FLAG-mSIRPa(32-373)-V5-HIS |
| SYN3159 | Nissle delta | pUC-ptet-PhoA-FLAG-CV1sirpα-V5-HIS |
| SYN3160 | Nissle delta | pUC-ptet-PhoA-FLAG-FD6x2sirpα-V5- |
| SYN3021 | Nissle delta | pUC-ptet-PhoA-SIRPαCV1hIgG4-V5- |
| SYN3020 | Nissle delta | pUC-ptet-PhoA-FD6sirpαhIgG4-V5-HIS |
| SYN3161 | Nissle delta | pUC-tet-PhoA-αmCD47scFv-V5-HIS |

*E. coli* Nissle strains SYN1557, SYN2996, SYN3159, SYN3160, SYN3021, SYN3020, and SYN3161, were grown overnight in LB medium. Cultures were diluted 1:100 in LB and grown shaking (200 rpm) to an optical density of 0.8 at which time culture was cooled down to room temperature and anhydrous tetracycline (ATC) was added to cultures at a concentration of 100 ng/mL to induce expression of SIRPα or SIRPα variants, or CD47 scFvs.

After 18 hours of induction, cells were spun down, and supernatants were collected. To generate cell free medium, the clarified supernatants were further filtered through a 0.22 micron filter to remove any remaining bacteria and placed on ice.

Figure 26:
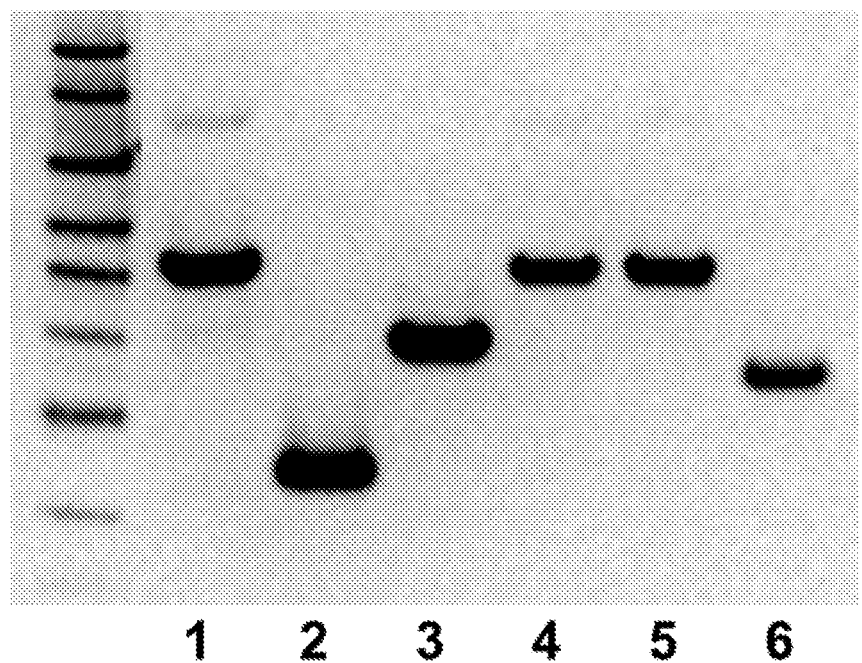
FIG. 26 depicts a Western blot analysis of bacterial supernatants from SYN2996 (lane 1), SYN3159 (lane 2), SYN3160 (lane 3), SYN3021 (lane 4), SYN3020 (lane 5), and SYN3161 (lane 6) showing that WT mSIRPα, mCV1SIRPα, mFD6×2SIRPα, mCV1SIRPα-IgG4, mFD6SIRPα-IgG4, and anti-mCD47 scFv are secreted from these strains, respectively.

Supernatant was then analyzed by western blot. Proteins in 25 µL supernatant were transferred onto PVDF membranes and SIRPα and SIRPα variants and anti-CD47 scFv were detected using anti-V5-HRP antibody (Biolegend). Results are shown in FIG. 26. A single band was detected around 46 kDa for WT mSIRPα, 20 kDa for CV1SIRPα, 33 kDa for FD6x2 SIRPα, 42 kDa for FD6SIRPα-IgG4, 42 kDa for CV1SIRPα-IgG4, and 30 kDa for anti-CD47 scFv, respectively.

To determine whether the wild type SIRPα, SIRPα variants, and anti-CD47-scFvs secreted by the genetically engineered *E. coli* Nissle can functionally bind to CD47 and/or are detected by an anti-SIRPα antibody, an ELISA assay was performed by coating the plate with corresponding antibodies or ligands. Results are shown in Table 37 and indicate that both the secreted mSIRPα and anti-mCD47scFv by the genetically engineered bacteria can bind to mCD47.

TABLE 37

SIRPα/CD47 ELISA Binding Assay

| Samples | Coating Materials | | | |
| --- | --- | --- | --- | --- |
|  | mCD47 | Anti-mSIRPα | IgG | PBS |
| PBS | 0.051 | 0.054 | 0.054 | 0.051 |
| Control | 0.056 | 0.052 | 0.053 | 0.054 |
| Secreted WT mSIRPα | 1.069 | 0.829 | 0.056 | 0.059 |

| Samples | Coating Materials | | |
| --- | --- | --- | --- |
|  | mCD47 | IgG | PBS |
| PBS | 0.046 | 0.053 | 0.048 |
| Control | 0.049 | 0.051 | 0.048 |
| Secreted anti-mCD47 scFv | 0.527 | 0.067 | 0.053 |

To determine whether the SIRPα, SIRPα variants, and anti-CD47 scFv secreted from in E coli Nissle bind to CD47 on mouse cells, flow cytometric analysis was performed using CT26 cells. CT26 is a mouse colon carcinoma cell line which expresses CD47 on its cell surface.

Figure 27:
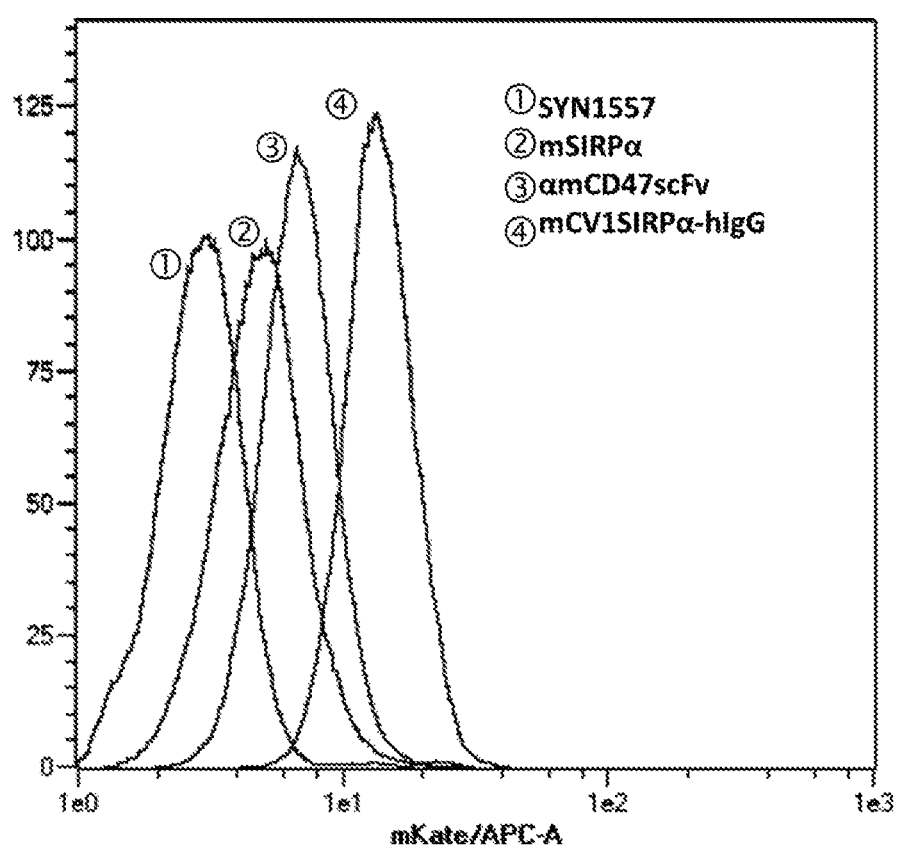
FIG. 27 depicts a diagram of a flow cytometric analysis of CD47 expressing CT26 cells which were incubated with supernatants from a SYN1557 (1; delta PAL parental strain), SYN2996 (2; expressing tet inducible mSIRPα), SYN3021 (3; expressing tet inducible anti-mCD47scFv), SYN3161 (4; expressing tet inducible mCV1SIRPα-hIgG fusion) and showing that secreted products expressed in *E. coli* can bind to CD47 on mouse CT26 cells.
Figure 28:
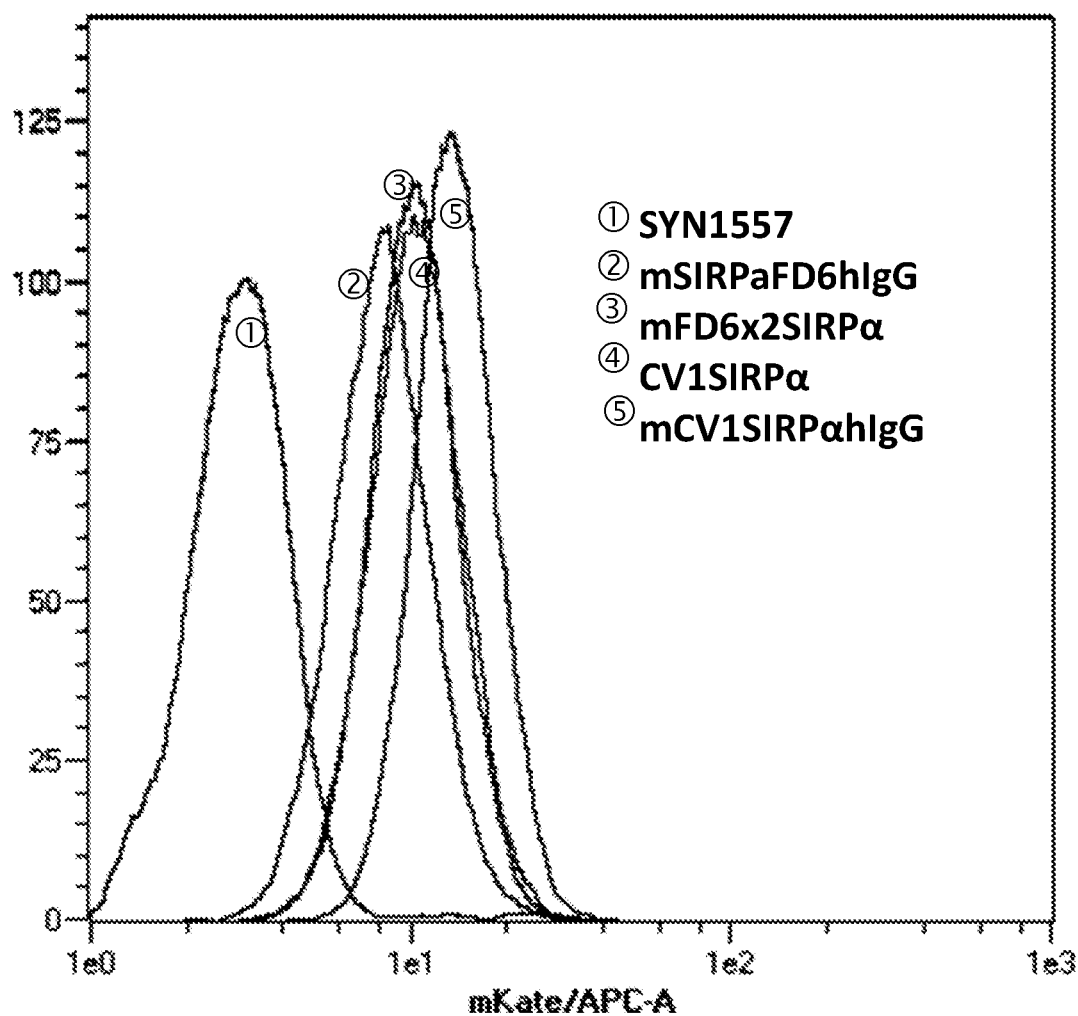
FIG. 28 depicts a diagram of a flow cytometric analysis of CD47 expressing CT26 cells which were incubated with supernatants from a SYN1557 (1; delta PAL parental strain), SYN3020 (2; expressing tet inducible mFD6SIRPα-hIgG fusion), SYN3160 (3; expressing tet inducible FD1×2SIRPα), SYN3159 (4; expressing tet inducible mCV1SIRPα), SYN3021 (5; expressing tet inducible mCV1SIRPα-hIgG fusion) and showing that secreted products expressed in E. coli can bind to CD47 on mouse CT26 cells.

CT26 cells were grown in Dulbecco's Modified Eagle's Medium (DMEM) with 10% FBS and 1% Penicillin-Streptomycin. Cells were spun down, supernatant was aspirated, pellet was resuspended in 1 ml D-PBS, transferred into chilled assay tubes (1×10^6 cells), and washed 3 times in D-PBS. Cells were resuspended in D-PBS with 0.5% BSA, to which the 10 µL of the supernatant (10× concentrated) were added and incubated for 1 hour at 4 C. Supernatant from SYN1557 was used as a baseline negative control. Cells were then resuspended in 0.5 ml PBS, diluted to proper concentration and analyzed on a flow cytometer. Results are shown in (FIG. 27 and FIG. 28). A population shift relative to baseline is observed for the samples containing the secreted SIRPα, SIRPα variants, and anti-CD47 scFv, with the greatest shift observed with SYN3021, expressing CV1SIRPα-IgG4.

Figure 29:
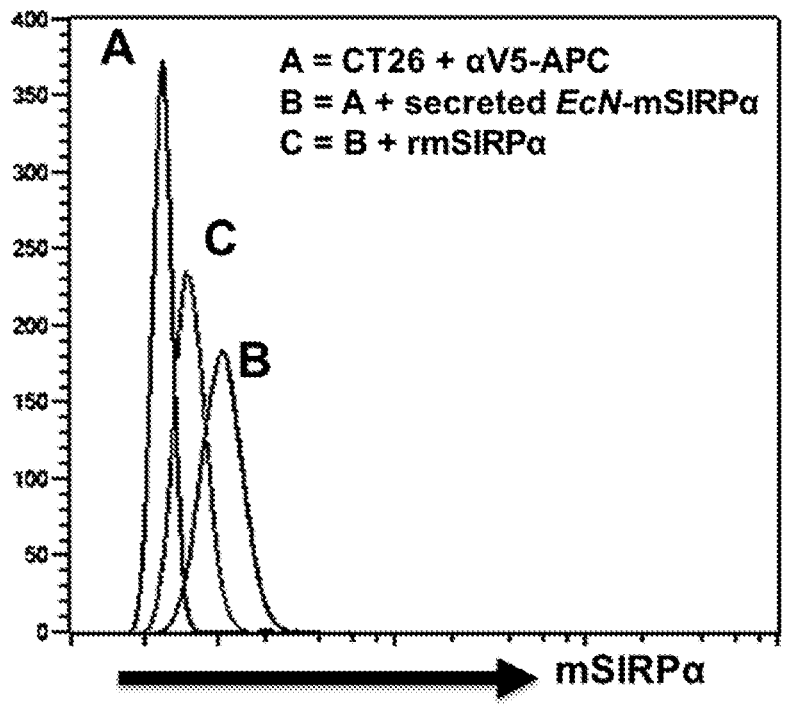
FIG. 29 depicts a diagram of a flow cytometric analysis of CT26 cells. A competition assay was conducted, in which extracts from a E coli Nissle strain secreting tet-inducible murine SIRPalpha was incubated with recombinant SIRPalpha showing that recombinant SIRPalpha can compete with the binding of SIRPalpha secreted from E. coli Nissle to CD47 on CT26 cells.
Figure 30:
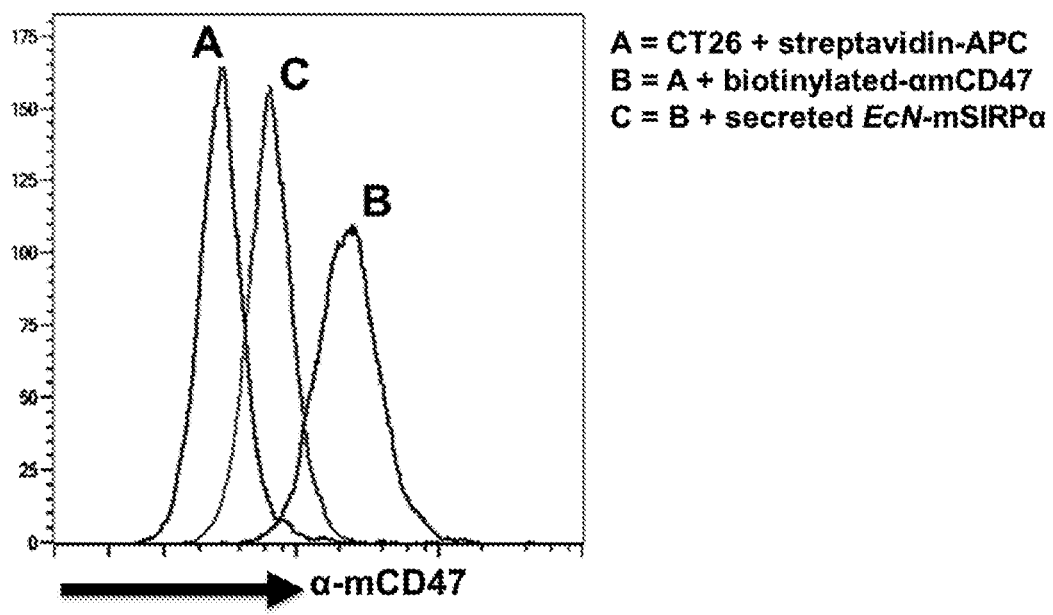
FIG. 30 depicts a diagram of a flow cytometric analysis of CT26 cells. A competition assay was conducted, in which extracts from a E coli Nissle strain secreting tet-inducible murine SIRPalpha was incubated with an anti-CD47 antibody showing that the antibody can compete with the binding of SIRPalpha secreted from E. coli Nissle to CD47 on CT26 cells.

Next, a competition assay was conducted to determine whether the murine SIRPα secreted by the genetically engineered bacteria could compete with the binding of a recombinant mSIRPα or an anti-CD47 antibody to murine CD47 on CT26 cells. CT26 cells were grown and flow cytometry protocol was conducted essentially as described above except that recombinant SIRPα (Rndsystems) or an anti-CD47 antibody (Biolegend) was added during the incubation of the secreted FD6×2sirpα or FD6sirpαhIgG4. FIG. 29 and FIG. 30 show the results of the competition with recombinant SIRPalpha and anti-CD47 antibody, respectively. Both recombinant SIRPalpha and anti-CD47 antibody were able to compete with the secreted SIRPalpha for the binding to CD47 on the CT26 cells.

Example 33. Secretion of Hyaluronidase

Figure 31A:
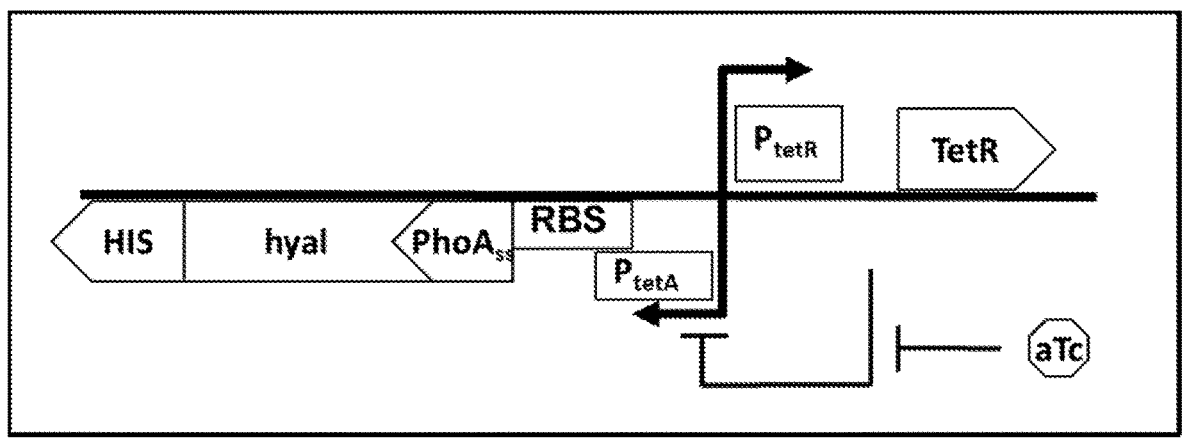
FIG. 31A depicts the circuitry for the secretion of mouse and human hyaluronidases expressed in SYN2997 and SYN2998.

To generate genetically engineered bacteria which are capable of secreting hyaluronidase, constructs were generated according to methods described herein as shown in FIG. 31A (SYN2998: Nissle delta PAL::CmR; p15A-ptet-RBS-PhoA--FLAG-human hyaluronidase-V5-His tags; SYN2997: Nissle delta PAL::CmR; p15A-ptet-RBS-PhoA-FLAG-human hyaluronidase-V5-His; SYN3369: Nissle delta PAL::CmR; p15A-ptet-RBS-PhoA-FLAG-leech hyaluronidase-V5-His).

E. coli Nissle strains SYN1557, SYN2997 (secreting mouse hyaluronidase), SYN2998 (secreting human hyaluronidase) and SYN3369 (secreting leech hyaluronidase), were grown overnight in LB medium. Cultures were diluted 1:100 in LB and grown shaking (200 rpm) to an optical density of 0.8 at which time culture was cooled down to room temperature and anhydrous tetracycline (ATC) was added to cultures at a concentration of 100 ng/mL to induce expression hyaluronidase.

After 18 hours of induction, cells were spun down, and supernatant was collected. To generate cell free medium, the clarified supernatant was further filtered through a 0.22 micron filter to remove any remaining bacteria and placed on ice.

Figure 31B:
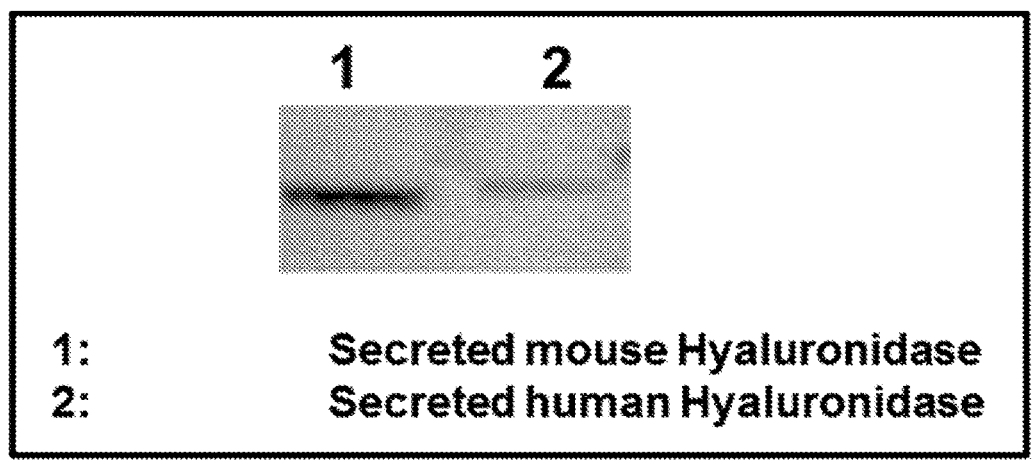
FIG. 31B depicts a Western blot analysis of bacterial supernatants from SYN2997 (lane 1) and SYN2998 (lane 2), showing that mouse and human hyaluronidases are secreted from these strains, respectively.

Supernatants were then analyzed by western blot. Proteins in 25 µL supernatant were transferred onto PVDF membranes and hyaluronidase was detected using anti-V5-HRP antibody (Biolegend). Results are shown in FIG. 31B. A single band was detected around 50 kDa for both secreted mouse and human hyaluronidases and around 57 kDa for leech hyaluronidase.

Figure 32:
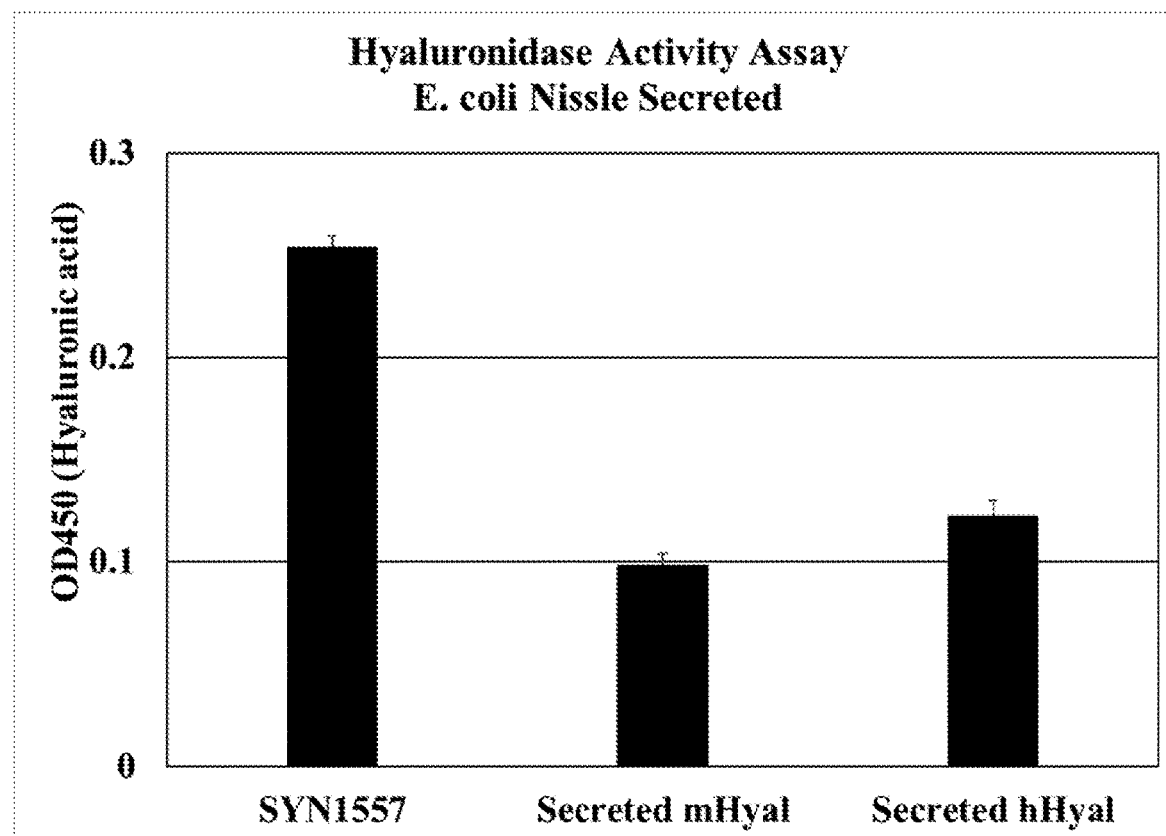
FIG. 32 depicts a bar graph showing hyaluronidase activity of SYN1557 (parental strain delta PAL), SYN2997 and SYN2998 as a measure of hyaluronan degradation in an ELISA assay.
Figure 33A:
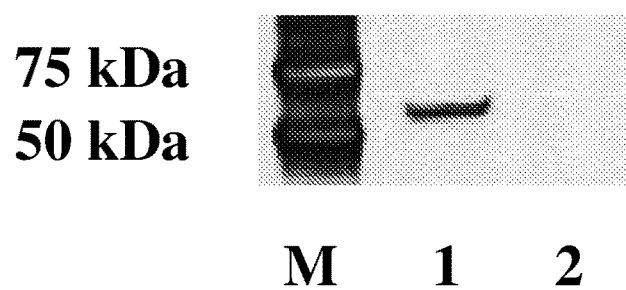
FIG. 33A depicts a Western blot analysis of bacterial supernatants from SYN3369 expressing tetracycline inducible leech hyaluronidase (lane 1) and SYN1557 (parental strain delta PAL) (lane 2), showing that leech hyaluronidase is secreted from SYN3369. M=Marker.
Figure 33B:
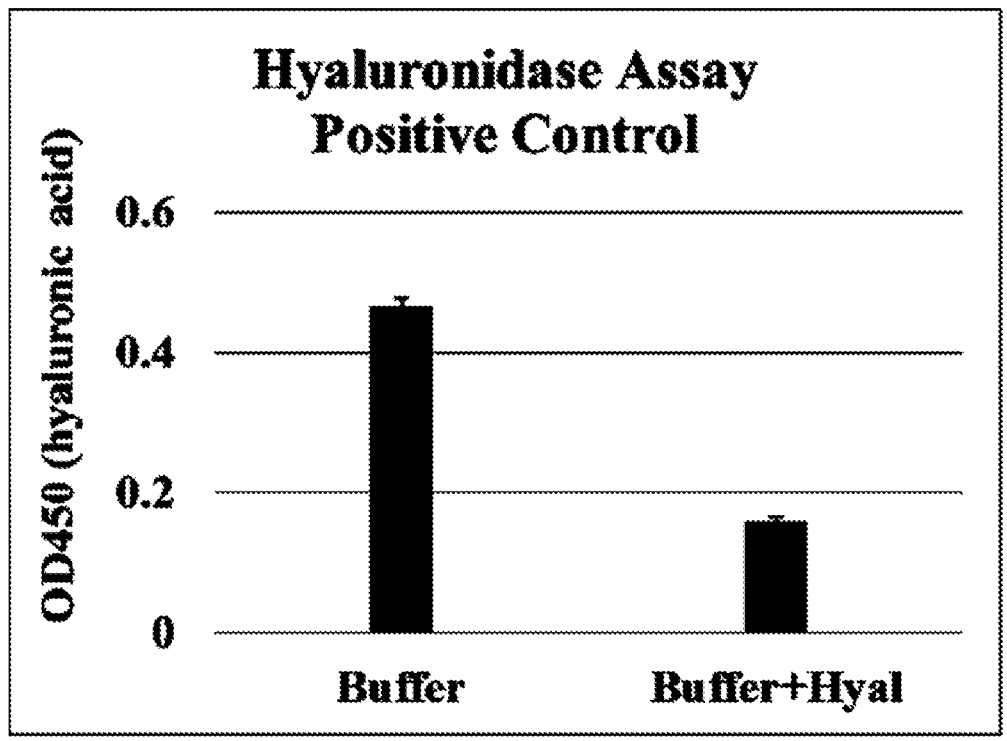
FIG. 33B and FIG. 33C depict a bar graphs showing hyaluronidase activity as a measure of hyaluronan degradation in an ELISA assay.
Figure 33C:
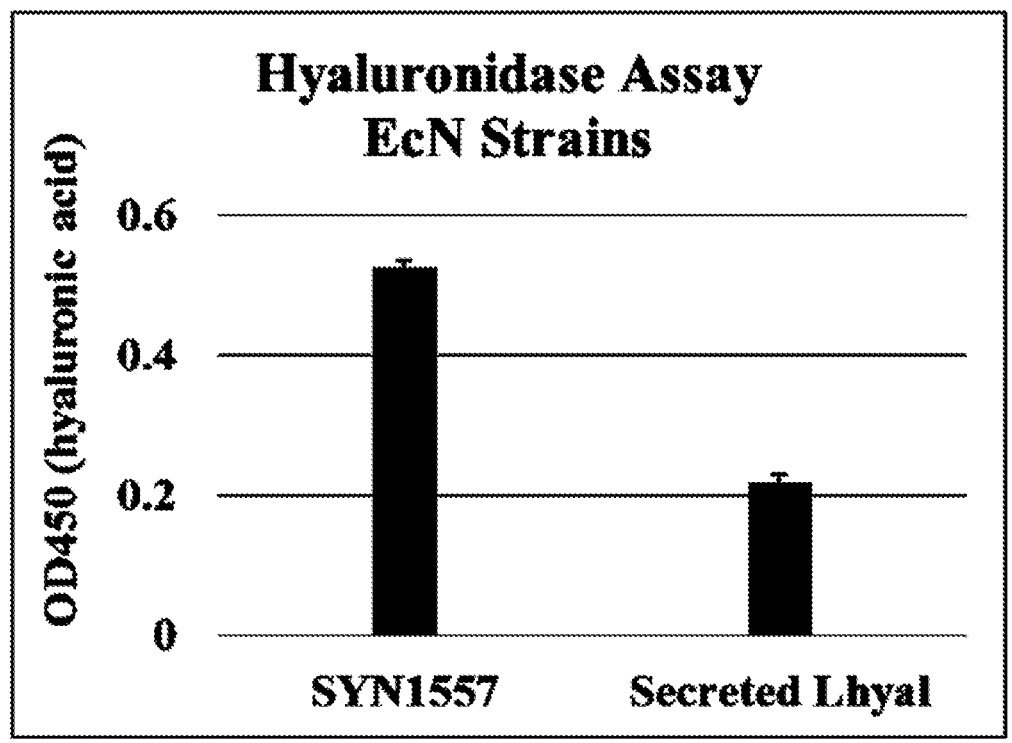
Figure 34:
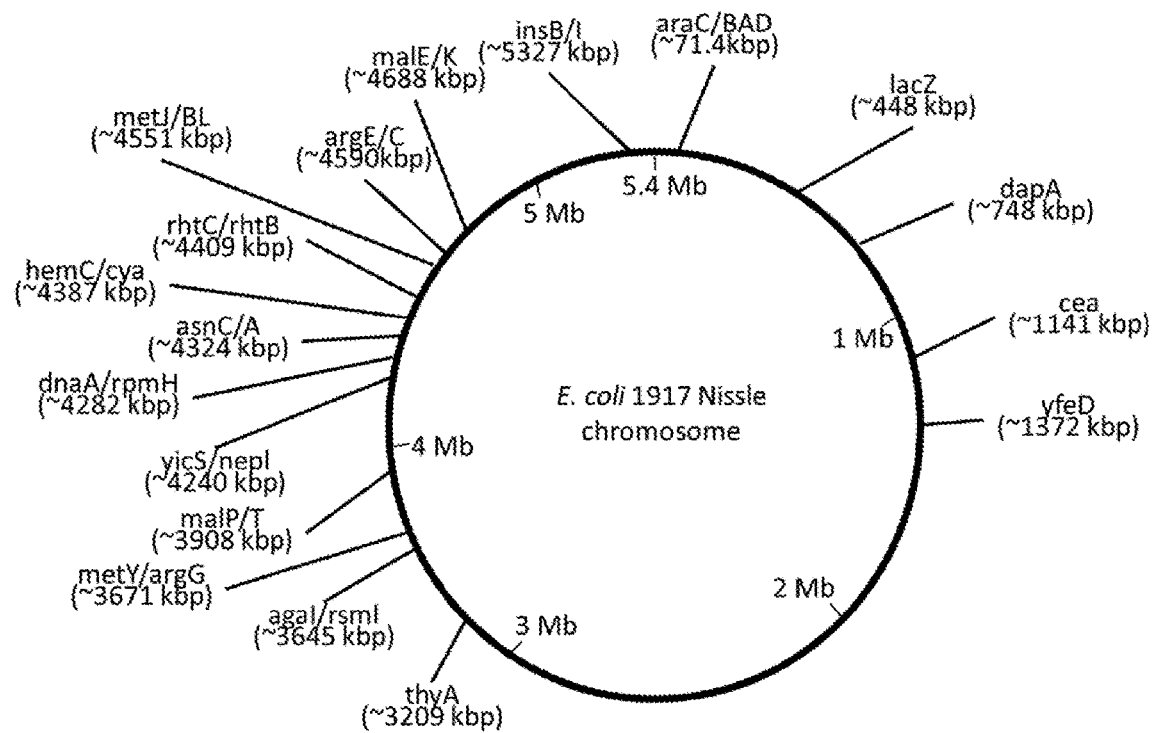
FIG. 34 depicts a map of exemplary integration sites within the E. coli 1917 Nissle chromosome. These sites indicate regions where circuit components may be inserted into the chromosome without interfering with essential gene expression. Backslashes (/) are used to show that the insertion will occur between divergently or convergently expressed genes. Insertions within biosynthetic genes, such as thyA, can be useful for creating nutrient auxotrophies. In some embodiments, an individual circuit component is inserted into more than one of the indicated sites. In some embodiments, multiple different circuits are inserted into more than one of the indicated sites. Accordingly, by inserting circuitry inot multiple sites into the E. coli 1917 Nissle chromosome a genetically engineered bacterium may comprise circuitry allowing multiple mechanisms of action (MoAs).
Figure 35:
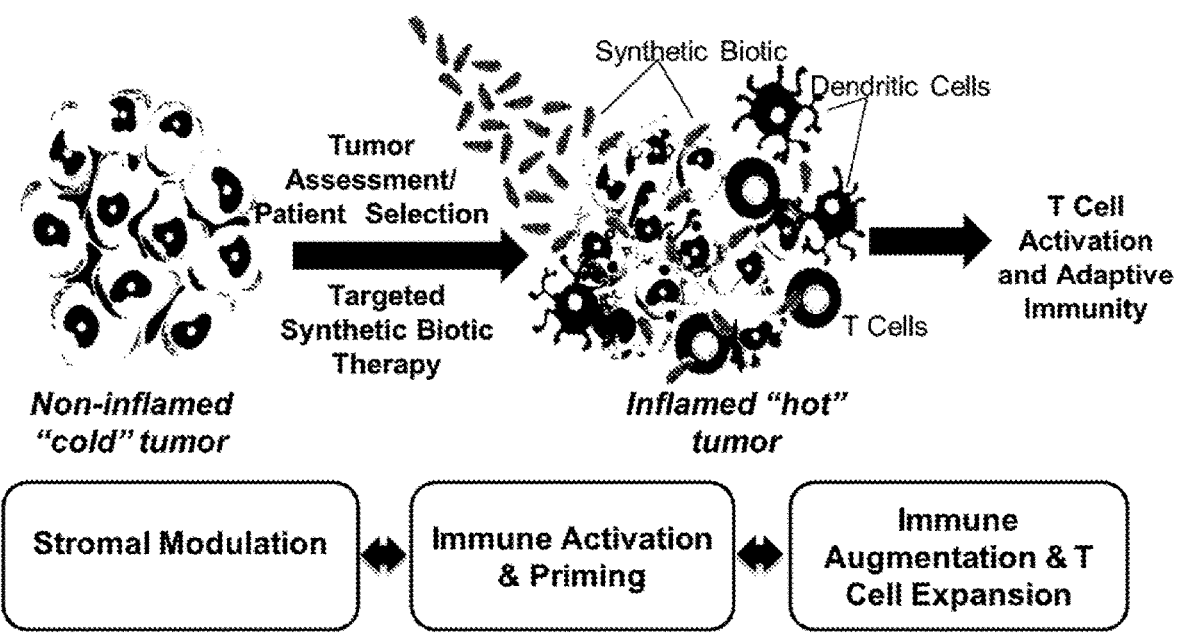
FIG. 35 depicts a schematic showing how genetically engineered bacteria of the disclosure can transform the tumor microenvironment by complementing stromal in immune deficiencies to achieve wide anti-tumor activity.

To determine whether the hyaluronidase secreted by the genetically engineered E. coli Nissle is active, a hyaluronidase activity assay on ability to cleave hyaluronan was performed, using biotinylated hyaluronate coated plate, according to manufacturer's instructions. Briefly, hyaluronidase will cleaved the polymer and result in the loss of biotin on plate which can then be detected by streptavidin-HPR and substrate. Results are shown in FIG. 32 and indicate that hyaluronidase secreted by the genetically engineered bacteria is able to degrade hyaluronan. The parental strain SYN1557 was used as a negative control. Results obtained for secreted leech hyaluronidase are shown in FIG. 33A, FIG. 33B, and FIG. 33C.

Example 34. An Engineered IL-15-Producing E. coli Nissle Strain Strain Construction and Biochemical Analysis To generate an engineered E. coli Nissle strain capable of secreting biologically active interleukin 15 (IL-15) a fusion protein was constructed, in which IL-15 is fused to the minimal region of IL-15Rα required for the formation of a functional receptor, known as the Sushi domain. IL-15 and IL-15Rα form functional complexes, which stimulate cell signaling, and activation and proliferation of neighboring lymphocytes expressing IL-2Rβ and γc in a process called trans-presentation (see, e.g., Ochoa et al., High-density lipoproteins delivering interleukin-15; Oncoimmunology. 2013 Apr. 1; 2(4): e23410). The biological activity of IL-15 is greatly improved by two different modifications: an asparagine to aspartic acid substitution at amino acid 72 of IL-15 (Zhu X, Marcus W D, Xu W, Lee H I, Han K, Egan J O, Yovandich J L, Rhode P R, Wong H C. Novel human interleukin-15 agonists. J Immunol. 2009; 183:3598-3607) and/or direct fusion with the sushi domain of IL-15Rα by mimicking trans-presentation of IL-15 by cell-associated IL-15Rα (Mortier et al., Soluble interleukin-15 receptor alpha (IL-15R alpha)-sushi as a selective and potent agonist of IL-15 action through IL-15R betagamma. Hyperagonist IL-15×IL-15R alpha fusion proteins. J Biol Chem 2006; 281:1612-9).

To produce the modified recombinant IL-15-Sushi fusion protein, IL-15 monomer with an N72D mutation was fused to the C-terminus of the sushi domain (78 amino acids) linked by a 20 amino acid linker. To the N-termini of the IL-15R sushi domain, a FLAG-tag and Factor Xa cleavage site was included to facilitate detection, purification and removal of the tag. To promote translocation to the periplasm, the IL15 fusion protein was cloned into a 10-member plasmid library. The coding sequence for the secreted fusion protein was codon optimized for expression in E. coli and ordered from IDT Technologies as a double-stranded DNA fragment. Once the DNA was received it was digested and ligated into the 10-member plasmid library using standard cloning procedures. Each member of the plasmid library contains a low-copy plasmid backbone and a Ptet promoter that drives expression of variable optimized ribosome-binding sites and secretion tags. Once the IL-15 fusion was cloned C-terminally of the secretion tags, the plasmids were transformed into SYN1557 (deltaPAL, diffusible outer membrane (DOM) phenotype) to create the IL-15-Sushi secretion strains SYN3516-SYN3525. Non-limiting examples of construct sequences include SEQ ID NO: 1132-1137 and SEQ ID NO: 1138-1144. Table 37 provides a description of the IL-15-Sushi strains. Table 38 provides a listing of strains generated using WT IL-15.

TABLE 37

Strain descriptions

| ID | Genotype | Construct |
|---|---|---|
| SYN3424 | PAL (PAL::Cm) | pBR322.Ptet.PpiA (ECOLIN_18620)-IL-15 |
| SYN3423 | PAL (PAL::Cm) | pBR322.Ptet.phoA-IL-15 |
| SYN3422 | PAL (PAL::Cm) | pBR322.Ptet.PelB-IL-15 |
| SYN3421 | PAL (PAL::Cm) | pBR322.Ptet.OppA-IL-15 |
| SYN3420 | PAL (PAL::Cm) | pBR322.Ptet.MalE-IL-15 |
| SYN3419 | PAL (PAL::Cm) | pBR322.Ptet.HdeB-IL-15 |
| SYN3418 | PAL (PAL::Cm) | pBR322.Ptet.GspD-IL-15 |
| SYN3417 | PAL (PAL::Cm) | pBR322.Ptet.GltI- IL-15 |
| SYN3416 | PAL (PAL::Cm) | pBR322.Ptet.DsbA- IL-15 |
| SYN3415 | PAL (PAL::Cm) | pBR322.Ptet.Adhesin- IL-15 |

TABLE 38

Strain descriptions

| ID | Genotype | Construct |
|---|---|---|
| SYN3525 | | pBR322.Ptet PpiA (ECOLIN_18620)-IL-15-Sushi |
| SYN3524 | PAL (PAL::Cm) | pBR322.Ptet.phoA-IL-15-Sushi |
| SYN3523 | PAL (PAL::Cm) | pBR322.Ptet.PelB-IL-15-Sushi |
| SYN3522 | PAL (PAL::Cm) | pBR322.Ptet.OppA-IL-15-Sushi |
| SYN3521 | PAL (PAL::Cm) | pBR322.Ptet.MalE-IL-15-Sushi |
| SYN3520 | PAL (PAL::Cm) | pBR322.Ptet.HdeB-IL-15-Sushi |
| SYN3519 | PAL (PAL::Cm) | pBR322.Ptet.GspD-IL-15-Sushi |
| SYN3518 | PAL (PAL::Cm) | pBR322.Ptet.GltI- IL-15-Sushi |
| SYN3517 | PAL (PAL::Cm) | pBR322.Ptet.DsbA- IL-15-Sushi |
| SYN3516 | PAL (PAL::Cm) | pBR322.Ptet.Adhesin- IL-15-Sushi |

Production of and In Vitro Quantification of IL-15 by SYN3525

To assay for production of IL-15 and/or to quantify bioactivity, cultures were grown and induced, then supernatants were harvested and quantified by ELISA. Prior to assay date, both the negative control strain (SYN1557) and the IL-15-sushi domain producing strains (SYN3516-SYN3525) were struck onto LB agar plates and grown at 37° C. with the appropriate antibiotics. A 2 mL starter culture of 2YT broth was inoculated with a single colony for every 50 mL of induced culture to be grown, allowed to grow at 37° C. for 2 hours, spun down at 8000×g for 10 minutes, and cells were resuspended in 2YT media of the original volume with the anhydrotetracycline (aTc) inducer (100 ng/mL). These cultures were placed at 30° C. with shaking for 4 hours to induce IL-15-sushi fusion protein production. Next, cultures were removed from the incubator and centrifuged at 20,000×g for 10 minutes to pellet all cells and the supernatants were passed through a 0.22 μm filter to yield sterilized supernatants. These supernatants were used in cell-based assays.

To evaluate the production of IL-15 fusions by the plasmid library, cultures of SYN1557 and the IL-15—producing library were induced and harvested in duplicate. These supernatants were serially-diluted and quantified using an IL-15 ELISA Kit (Human IL-15 Quantikine ELISA Kit—D1500, R&D Systems, Minneapolis, Minn.). The data from screening the secretion library displayed in Table 39 shows maximal production from SYN3525, which contains the PpiA secretion signal from E. coli as the leader peptide. SYN1557 supernatants showed no cross-reactivity in the ELISA (data not shown).

TABLE 39

| Strain | Secretion (ng/ml; average of 2) |
|---|---|
| SYN3525 | 84.78 |
| SYN3524 | 46.25 |
| SYN3523 | 92.88 |
| SYN3522 | 53.84 |
| SYN3521 | 54.71 |
| SYN3520 | 80.36 |
| SYN3519 | 37.98 |
| SYN3518 | 59 |
| SYN3517 | 42.81 |
| SYN3516 | 36.33 |

To further evaluate the production of IL-15 from SYN3525, the strain was grown and induced in baffled flasks to generate maximum yield. From the filtered supernatants of SYN3525, samples of SYN1557 and SYN3525 were diluted in triplicate and run on an ELISA Kit (Human IL-15 Quantikine ELISA Kit—D1500, R&D Systems, Minneapolis, Minn.). The results of these analyses are shown in Table 40. The results showed that under maximal induction conditions the SYN3525 supernatant contained between 733-795 ng/mL of material that reacted positively in the IL-15 ELISA assay. In contrast, the SYN1557 supernatants had undetectable levels (not shown).

TABLE 40

SYN3525 supernatant results from three different ELISA runs.

| SYN3525 | IL-15 (ng/ml) |
|---|---|
| Run 1 | 795.23 |
| Run 2 | 733.75 |
| Run 3 | 792.80 |
| AVERAGE | 773.93 |
| SEM (n = 3) | 20.10 |

For comparison, Secretion from constructs expressing WT IL-15 are shown in Table 41.

TABLE 41

| Strain number | ng/mL (Average of 2) |
|---|---|
| SYN3424 | 2.26 |
| SYN3423 | 7.83 |
| SYN3422 | 1.78 |
| SYN3421 | 0.09 |
| SYN3420 | 0.04 |

TABLE 41-continued

| Strain number | ng/mL (Average of 2) |
|---|---|
| SYN3419 | 0.83 |
| SYN3418 | 10.42 |
| SYN3417 | 0.37 |
| SYN3416 | 1.06 |
| SYN3415 | 0.43 |

Example 35. Functional Assay for Bacterially Secreted IL-15

Next a functional assay was conducted to demonstrate that IL-15 secreted from SYN3525 was functional. STAT3 and STAT5 have been shown to be phosphorylated by IL-15Ralpha upon ligand binding.

Figure 55:
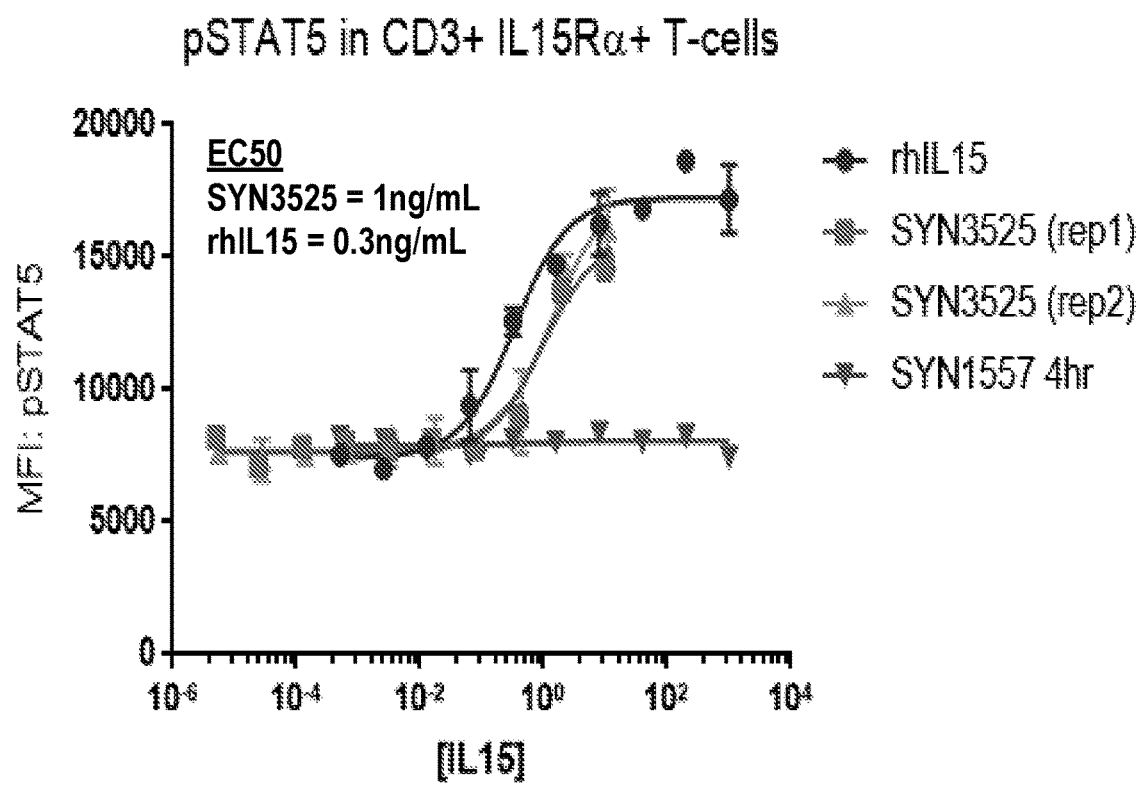
FIG. 55. depicts a line graph showing the results of a cell-based assay showing STAT5 phosphorylation in CD3+ IL15RAalpha+ T-cells upon treatment with supernatants of the IL-15 secreter SYN3525 (PAL::Cm p15a Ptet-PpiA (ECOLIN_18620)-IL-15-Sushi), the parental control SYN1557, and a recombinant IL-15 control.

T-cells were purified from human leukopheresis via Miltenyi untouched pan-T-cell kit (yield=~5e7 cells/prep). IL15Ra expression was induced via mild stimulation with Phytohaemagglutinin P (PHA) for 48 hrs. The activated T-cells were treated with supernatants from IL15 expressing bacteria SYN 3525 for 15 min. The treated cells were fixed in paraformaldehyde based solution followed by harsh permeabilization in 90% methanol. Modulation of phospho-STAT5 was quantified by multi-color flow cytometry in IL15R+CD3+ cells. Results are shown in FIG. 55 and show that SYN3525 derived IL15 exhibits bioactivity comparable to that of rhIL15. Consistent results were observed between supernatants from two individually bacterial preps.

Example 36. Construction of a Dimerized IL-12 for Secretion

Strain Engineering: To generate an engineered E. coli Nissle strain capable of secreting biologically active Interleukin 12 (IL-12) heterodimer, a construct was generated in which two interleukin-12 monomer subunits (IL-12A (p35) and IL-12B (p40)) were covalently linked by a linker.

To facilitate the dimerization of recombinant human IL-12 protein produced from E. coli Nissle, a 15 amino acid linker of 'GGGGSGGGGSGGGGS' (SEQ ID NO: 1247) was inserted between two monomer subunits (IL-12A (p35) and IL-12B (p40)) to produce a forced dimer human IL-12 (diIL-12) fusion protein, and the sequence was codon-optimized.

To promote translocation to the periplasm, secretion tags were added to the N-terminus of the diIL-12 fusion protein. The DNA sequence containing the elements of the inducible Ptet promoter, ribosome binding site, diIL-12 coding sequence and other necessary linkers were synthesized by IDT Technologies and subsequently cloned into a high copy number plasmid vector. The plasmid was transformed into SYN1555, SYN1556, SYN1557 or SYN1625 (comprising the nlpI, tolA, PAL, or lpp deletion respectively to create the diffusible membrane phenotype) to create the dimerized human IL-12 (diIL-12) secretion strains.

TABLE 43

Non-limiting IL-12 Construct Sequences

| | |
|---|---|
| Construct comprising secretion tag 19410 - human IL-12 (p35) - Linker (15aa) - human IL-12 (p40) | SEQ ID NO: 1235 |
| Construct comprising secretion tag dsba - human IL-12 (p35) - Linker (15aa) - human IL-12 (p40) | SEQ ID NO: 1146 |
| Construct comprising secretion tag phoA - human IL-12 (p35) - Linker (15aa) - human IL-12 (p40) | SEQ ID NO: 1147 |
| Construct comprising secretion tag tolB - human IL-12 (p35) - Linker (15aa) - human IL-12 (p40) | SEQ ID NO: 1148 |
| Construct comprising secretion tag malE - human IL-12 (p35) - Linker (15aa) - human IL-12 (p40) | SEQ ID NO: 1149 |
| Construct comprising secretion tag mglB - human IL-12 (p35) - Linker (15aa) - human IL-12 (p40) | SEQ ID NO: 1150 |
| Construct comprising secretion tag ompF - human IL-12 (p35) - Linker (15aa) - human IL-12 (p40) | SEQ ID NO: 1151 |
| Construct comprising secretion tag ompA - human IL-12 (p35) - Linker (15aa) - human IL-12 (p40) | SEQ ID NO: 1152 |
| Construct comprising secretion tag tort - human IL-12 (p35) - Linker (15aa) - human IL-12 (p40) | SEQ ID NO: 1153 |
| Construct comprising secretion tag lamB - human IL-12 (p35) - Linker (15aa) - human IL-12 (p40) | SEQ ID NO: 1154 |
| Construct comprising secretion tag pelB - human IL-12 (p35) - Linker (15aa) - human IL-12 (p40) | SEQ ID NO: 1156 |
| human IL-12 (p35) - Linker (15aa) - human IL-12 (p40) | SEQ ID NO: 1168 |

TABLE 44

Non-limiting IL-12 Construct Polypeptide Sequences

| Description |
|---|
| Construct comprising secretion tag 19410 - human IL-12 (p35) - Linker (15aa) - human IL-12 (p40); (includes C terminal V5 and HIS tag and FLAG tag located at C terminus of secretion tag)     SEQ ID NO: 1169 |
| Construct comprising secretion tag dsba - human IL-12 (p35) - Linker (15aa) - human IL-12 (p40); (includes C terminal V5 and HIS tag and FLAG tag located at C terminus of secretion tag)     SEQ ID NO: 1170 |

TABLE 44-continued

Non-limiting IL-12 Construct Polypeptide Sequences

| Description | |
|---|---|
| Construct comprising secretion tag phoA - human IL-12 (p35) - Linker (15aa) - human IL-12 (p40); (includes C terminal V5 and HIS tag and FLAG tag located at C terminus of secretion tag) | SEQ ID NO: 1171 |
| Construct comprising secretion tag tolB - human IL-12 (p35) - Linker (15aa) - human IL-12 (p40); (includes C terminal V5 and HIS tag and FLAG tag located at C terminus of secretion tag) | SEQ ID NO: 1172 |
| Construct comprising secretion tag malE - human IL-12 (p35) - Linker (15aa) - human IL-12 (p40); (includes C terminal V5 and HIS tag and FLAG tag located at C terminus of secretion tag) | SEQ ID NO: 1173 |
| Construct comprising secretion tag mglB - human IL-12 (p35) - Linker (15aa) - human IL-12 (p40); (includes C terminal V5 and HIS tag and FLAG tag located at C terminus of secretion tag) | SEQ ID NO: 1174 |
| Construct comprising secretion tag ompF - human IL-12 (p35) - Linker (15aa) - human IL-12 (p40); (includes C terminal V5 and HIS tag and FLAG tag located at C terminus of secretion tag) | SEQ ID NO: 1175 |
| Construct comprising secretion tag ompA - human IL-12 (p35) - Linker (15aa) - human IL-12 (p40); (includes C terminal V5 and HIS tag and FLAG tag located at C terminus of secretion tag) | SEQ ID NO: 1176 |
| Construct comprising secretion tag tort - human IL-12 (p35) - Linker (15aa) - human IL-12 (p40); (includes C terminal V5 and HIS tag and FLAG tag located at C terminus of secretion tag) | SEQ ID NO: 1177 |
| Construct comprising secretion tag lamB - human IL-12 (p35) - Linker (15aa) - human IL-12 (p40); (includes C terminal V5 and HIS tag and FLAG tag located at C terminus of secretion tag) | SEQ ID NO:1178 |
| Construct comprising secretion tag pelB - human IL-12 (p35) - Linker (15aa) - human IL-12 (p40); (includes C terminal V5 and HIS tag and FLAG tag located at C terminus of secretion tag) | SEQ ID NO: 1179 |
| human IL-12 (p35) - Linker (15aa) - human IL-12 (p40) | SEQ ID NO: 1191 |
| Human IL-12 monomer p35 | SEQ ID NO: 1192 |
| Human IL-12 monomer p40 | SEQ ID NO: 1193 |
| Linker | SEQ ID NO: 1194 |

Production of diIL-12 by SYN3466 to SYN3505 for In Vitro Assays:

To assay for production of IL-12 and/or to quantify bioactivity, cultures were grown and induced, then supernatants were harvested and quantified via ELISA, as follows using shaker plate. Both the negative control strain (SYN1555, SYN1556, SYN1557 or SYN1625) and the diIL-12-producing strain (SYN3466 to SYN3505) were struck onto LB agar plates and grown at 37° C. with chloramphenicol, or chloramphenicol and carbenicillin, respectively. After overnight growth, an individual colony was picked and used to inoculate a 4 mL starter culture of 2YT broth for future shaker plate to be grown. The starter cultures were inoculated with the same antibiotics used in the agar plates. When the starter culture reached saturation, the culture was back-diluted 1:25 into a new shaker plate of 2YT with appropriate antibiotics. This starter culture was allowed to grow at 37° C. for 2 hours to an OD600=~0.8-1. The culture was then induced by adding aTc inducer (100 microg/mL). These induced cultures were incubated at 30° C. with shaking for 4 hours to promote IL-12 production.

When the production phase was complete, the shaker plate of cultures was removed from the incubator and centrifuged at 20000×g for 10 minutes to pellet all cells. The supernatants were kept for ELISA analysis.

Quantification of diIL-12 in Supernatants by ELISA:

To evaluate the amounts of diIL-12 in the supernatants, samples were assayed using a Human IL-12 p70 Quantikine ELISA Kit from R&D systems. The results of these analyses are shown in Table 45. The results showed that the supernatants contained between 17 and 309 pg/mL of material that reacted positively in the IL-12 ELISA assay. In contrast, the SYN1557 supernatants had undetectable levels.

TABLE 45

Supernatant results from ELISA analysis (pg/mL)

| Signal Peptides, Host strain | Vector | 19410 | pelB | tort | LamB | OmpF |
|---|---|---|---|---|---|---|
| Nissle delta nlpI::CmR | 15.1 | 130.7 | 61.4 | 255.6 | 81.6 | 17.0 |
| Nissle delta tolA::CmR | 12.8 | 47.7 | 93.0 | 205.3 | 189.8 | 220.2 |
| Nissle delta PAL::CmR | 10.2 | 142.3 | 31.2 | 266.7 | 167.0 | 62.8 |
| Nissle delta lpp::CmR | 10.5 | 233.7 | 57.9 | 278.6 | 107.2 | 128.4 |

| Signal Peptides, Host strain | OmpF | mglB | malE | tolB | phoA | dsbA |
|---|---|---|---|---|---|---|
| Nissle delta nlpI::CmR | 17.0 | 194.4 | 224.7 | 234.2 | 241.9 | 99.3 |
| Nissle delta tolA::CmR | 220.2 | 227.0 | 194.4 | 187.0 | 309.1 | 146.0 |
| Nissle delta PAL::CmR | 62.8 | 218.4 | 256.5 | 250.0 | 203.7 | 237.0 |
| Nissle delta lpp::CmR | 128.4 | 203.3 | 242.3 | 197.2 | 250.7 | 101.9 |

Example 37. An Engineered IL-15-Producing *E. coli* Nissle Strain

Strain Engineering

To generate an engineered *E. coli* Nissle strain capable of secreting biologically active interleukin 15 (IL-15) a fusion protein was constructed, in which IL-15 is fused to the minimal region of IL-15Rα required for the formation of a functional receptor, which is known as Sushi domain. IL-15 and IL-15Rα form functional complexes, which stimulate cell signaling, and activation and proliferation of neighboring lymphocytes expressing IL-2Rβ and γc in a process called trans-presentation (see, e.g., Ochoa et al., High-density lipoproteins delivering interleukin-15; Oncoimmunology. 2013 Apr. 1; 2(4): e23410). The biological activity of IL-15 is greatly improved by direct fusion with the sushi domain of IL-15Rα by mimicking trans-presentation of IL-15 by cell-associated IL-15Rα (Mortier et al., Soluble interleukin-15 receptor alpha (IL-15R alpha)-sushi as a selective and potent agonist of IL-15 action through IL-15R betagamma. Hyperagonist 1L-15×IL-15R alpha fusion proteins. J Biol Chem 2006; 281:1612-9).

To produce the recombinant IL-15-Sushi fusion protein, IL-15 monomer was fused to the C-terminus of the sushi domain linked by a 20 amino acid linker. To promote translocation to the periplasm, 19410, tort, or pelB secretion tag was added to the N-terminus of IL-15-Sushi fusion protein. The DNA sequence containing the Ptet promoter, RBS, coding sequence for IL-15-Sushi and other necessary linkers were synthesized by IDT Technologies and subsequently cloned into a high copy number plasmid vector provided by IDT Technologies under the control of a tet-inducible promoter. The plasmids were transformed into SYN1557 (delta PAL, diffusible outer membrane (DOM) phenotype) or SYN94 (no PAL deletion *E. coli* Nissle strain) to create the IL-15-Sushi secretion strains SYN3458 to SYN3463. Table 46 and Table 47 list a number of non-limiting examples of construct sequences.

Production of IL-15 by SYN3458 to SYN3463 for In Vitro Assays:

To assay for production of IL-15 and/or to quantify bioactivity, cultures were grown and induced, then supernatants were harvested and quantified by ELISA. Prior to assay date, both the negative control strain (SYN1557) and the IL-15-sushi domain producing strain SYN3458 to SYN3463 were struck onto LB agar plates and grown at 37° C. with the appropriate antibiotics. A 2 mL starter culture of 2YT broth was inoculated with a single colony for every 50 mL of induced culture to be grown, allowed to grow at 37° C. for 2 hours, spun down at 8000×g for 10 minutes, and cells were resuspended in 2YT media of the original volume with the anhydrotetracycline (aTc) inducer (100 ug/mL). These cultures were placed at 30° C. with shaking for 4 hours to induce IL-15-sushi fusion protein production. Next, cultures were removed from the incubator and centrifuged at 20,000×g for 10 minutes to pellet all cells and the supernatants were passed through a 0.22 μm filter to yield sterilized supernatants. These supernatants were used in cell-based assays.

Quantification of IL-15 in SYN3458 to SYN3463 Supernatants by ELISA:

To evaluate the production of IL-15 in the filtered supernatants, samples of SYN1557 and SYN3458 to SYN3463 were diluted in triplicate and run on an Human IL-15 Quantikine ELISA Kit (Ra&D Systems). The results of these analyses are shown in Table 48. The results showed that the SYN3458 to SYN3463 supernatant contained between 4 and 275 ng/mL of material that reacted positively in the IL-15 ELISA assay. In contrast, the SYN94 and SYN1557 supernatants had undetectable levels (not shown).

TABLE 46

Non-limiting IL-15 Construct Polypeptide Sequences

| Description | Sequence |
|---|---|
| Human IL-15Rα sushi domain | |
| Construct comprising 19410 secretion tag- Sushi- linker - human IL-15 | SEQ ID NO: 1195 |
| Construct comprising tort secretion tag- Sushi- linker - human IL-15 | SEQ ID NO: 1196 |
| Construct comprising pelB secretion tag- Sushi- linker - human IL-15 | SEQ ID NO: 1197 |
| Sushi- linker - human IL-15 | SEQ ID NO: 1198 |

TABLE 47

Non-limiting IL-15 Construct Polynucleotide Sequences

| Description | Sequence |
|---|---|
| Human IL-15Rα sushi domain | SEQ ID NO: 1345 |
| Construct comprising 19410 secretion tag- Sushi- linker - human IL-15 | SEQ ID NO: 1200 |
| Construct comprising tort secretion tag- Sushi- linker - human IL-15 | SEQ ID NO: 1201 |
| Construct comprising pelB secretion tag- Sushi- linker - human IL-15 | SEQ ID NO: 1202 |
| Sushi- linker - human IL-15 | SEQ ID NO: 1203 |
| Human IL-1 | SEQ ID NO: 1204 |
| Linker | SEQ ID NO: 1199 |

TABLE 48

Supernatant results from three different ELISA runs.

| final strain | host strain | plasmid | ng/mL |
|---|---|---|---|
| SYN3460 | SYN1557 | ptet-pelBss-hIL15-SUSHI-fusion | 275 |
| SYN3461 | SYN1557 | ptet-19410ss-hIL15-SUSHI-fusion | 166 |
| SYN3458 | SYN1557 | ptet-tortss-hIL15-SUSHI-fusion | 59 |
| SYN3459 | SYN94 | ptet-tortss-hIL15-SUSHI-fusion | 78 |
| SYN3462 | SYN94 | ptet-pelBss-hIL15-SUSHI-fusion | 4 |
| SYN3463 | SYN94 | ptet-19410ss-hIL15-SUSHI-fusion | 72 |

Example 38. CXCL10 Secretion

To produce the recombinant CXCL10 chemokine, a synthetic construct was devised (no data provided). The secreted/soluble form of the CXCL10 protein was codon optimized for expression in E. coli and ordered from IDT Technologies as a double-stranded DNA fragment. To promote translocation to the periplasm, the CXCL10 soluble protein was cloned into a 10-member plasmid library. Once the DNA was received it was digested and ligated into the 10-member plasmid library using standard cloning procedures. Each member of the plasmid library contains a low-copy plasmid backbone and a Ptet promoter that drives expression of variable optimized ribosome-binding sites and secretion tags. Once the CXCL10 was cloned C-terminally of the secretion tags, the plasmids were transformed into SYN1557 (ΔPAL, diffusible outer membrane (DOM) phenotype) to create the CXCL10 secretion strains, SYN3404 and SYN3406-SYN3414. Construct sequences include SEQ ID NO: 1205, SEQ ID NO: 1206, SEQ ID NO: 1208, and SEQ ID NO: 1209.

TABLE 49

Strain Descriptions

| ID | Genotype | Construct |
|---|---|---|
| SYN3414 | PAL (PAL::Cm) | p15a.Ptet.PpiA-CXCL10 |
| SYN3413 | PAL (PAL::Cm) | p15a.Ptet.phoA-CXCL10 |
| SYN3412 | PAL (PAL::Cm) | p15a.Ptet.PelB-CXCL10 |
| SYN3411 | PAL (PAL::Cm) | p15a.Ptet.OppA-CXCL10 |
| SYN3410 | PAL (PAL::Cm) | p15a.Ptet.MalE-CXCL10 |
| SYN3409 | PAL (PAL::Cm) | p15a.Ptet.HdeB-CXCL10 |
| SYN3408 | PAL (PAL::Cm) | p15a.Ptet.GspD-CXCL10 |
| SYN3407 | PAL (PAL::Cm) | p15a.Ptet.GltI-CXCL10 |
| SYN3406 | PAL (PAL::Cm) | p15a.Ptet.DsbA-CXCL10 |
| SYN3404 | PAL (PAL::Cm) | p15a.Ptet.Adhesin-CXCL10 |

To assay for production of CXCL10 and/or to quantify bioactivity, cultures were grown and induced, then supernatants were harvested and quantified by ELISA. Prior to assay date, both the negative control strain (SYN1557) and the CXCL10-producing strains (SYN3404-SYN3414) were struck onto LB agar plates and grown at 37° C. with the appropriate antibiotics. A 2 mL starter culture of 2YT broth was inoculated with a single colony for every 50 mL of induced culture to be grown, allowed to grow at 37° C. for 2 hours, spun down at 8000×g for 10 minutes, and cells were resuspended in 2YT media of the original volume with the anhydrotetracycline (aTc) inducer (100 ng/mL). These cultures were placed at 30° C. with shaking for 4 hours to induce CXCL10 protein production. Next, cultures were removed from the incubator and centrifuged at 20,000×g for 10 minutes to pellet all cells and the supernatants were passed through a 0.22 μm filter to yield sterilized supernatants. These supernatants were used in cell-based assays.

To evaluate the production of CXCL10 by the plasmid library, cultures of SYN1557 and the CXCL10-producing library were induced and harvested in duplicate. These supernatants were serially-diluted and quantified using a CXCL10 ELISA Kit (Human CXCL10/IP-10 Quantikine ELISA Kit—DIP100, R&D Systems, Minneapolis, Minn.). The data from screening our secretion library displayed in Table 50 shows maximal production from SYN3413, which contains the PhoA secretion signal from E. coli as the leader peptide. SYN1557 supernatants showed no cross-reactivity in the ELISA (data not shown).

TABLE 50

CXCL10 Secretion

| Strain Name | ng/mL (Average of 2) |
|---|---|
| SYN3414 | 5.54 |
| SYN3413 | 52.41 |
| SYN3412 | 11.06 |
| SYN3411 | 0.14 |
| SYN3410 | 0.09 |
| SYN3409 | 3.66 |
| SYN3408 | 35.79 |
| SYN3407 | 1.25 |
| SYN3406 | 1.22 |
| SYN3405 | 1.07 |

To further evaluate the production of CXCL10 from SYN3413, the strain was grown and induced in baffled flasks to generate maximum yield. From the filtered supernatants of SYN3413, samples of SYN1557 and SYN3413 were diluted in triplicate and run on an ELISA Kit (Human CXCL10/IP-10 Quantikine ELISA Kit—DIP100, R&D Systems, Minneapolis, Minn.). The results of these analyses are shown in Table 112. The results showed that under maximal induction conditions the SYN3413 supernatant contained between 199-232 ng/mL of material that reacted positively in the CXCL10 ELISA assay. In contrast, the SYN1557 supernatants had undetectable levels (not shown).

TABLE 51

Concentration of Secreted hCXCL10 from triplicate SYN3414

| SYN3414 | CXCL10 (ng/ml) |
|---|---|
| Run 1 | 199.71 |
| Run 2 | 231.96 |
| Run 3 | 232.16 |
| AVERAGE | 221.28 |
| SEM (n = 3) | 10.78 |

Functional Assay for CXCL10

To determine whether CXCL10 secreted from any of the strains described above is functional, a Chemotaxis Assay is performed, essentially as described in Mikucki et al. (Mikucki, et al., Non-redundant Requirement for CXCR3 Signaling during Tumoricidal T Cell Trafficking across Tumor Vascular Checkpoints; Nat Commun. 2015; 6: 7458, the contents of which is herein incorporated by reference in its entirety).

Briefly, cell trace labeled naïve (or expanded) human CD8+ T cells are transferred into 24-well transwell plate (5 uM pore) with T cells on top (5×105 cells) and rCXCL10/ supernatants on bottom, in the presence or absence of PTX or anti-CXCL10)->Cells are incubated for 3 hrs, and migrated cells are counted by flow cytometry. Alternatively, phosphoAKT is measured by flow, western or ELISA.

Example 39. Generation of STING Agonist Producing Strains

To generate STING agonist strains, DacA (*Listeria monocytogenes* cyclic di AMP synthase) was cloned into p15 under the control of the $P_{tet}$ promoter; to generate the strain as described in Table 53. Summarizes sequences of the constructs.

TABLE 53 c-di-AMP producing strain

| Strain: | Genotype |
|---|---|
| SYN3527 | Nissle p15A Ptet-DacA (*listeria monocytogenes* cyclic di AMP synthase) |

Example 40. In Vitro STING Agonist Production

The ability of the newly generated strain to produce c-di-AMP was first assessed in vitro.

*E. coli* Nissle strains SYN3527 (comprising the DacA construct) and a control strain were grown overnight in LB medium. Cultures were diluted 1:25 in M9 minimal media supplemented with 0.5% glucose (w/v) and grown shaking (350 rpm) at 37° C. for 2 hours. Cultures were diluted to an optical density of 0.5 at which time anhydrous tetracycline (ATC) was added to cultures at a concentration of 100 ng/mL to induce expression of DacA. After 4 hours of induction, samples were removed for LC/MS analysis of cyclic dinucleotide production. Samples were centrifuged for 20 minutes at 5000 RPM to separate cellular and extracellular fractions. Cell pellets were then used to determine intracellular cyclic-di-AMP and the media supernatants were used to determined extracellular accumulation of cyclic-di-AMP. Concentrations were determined via LC/MS.

Figure 42B:
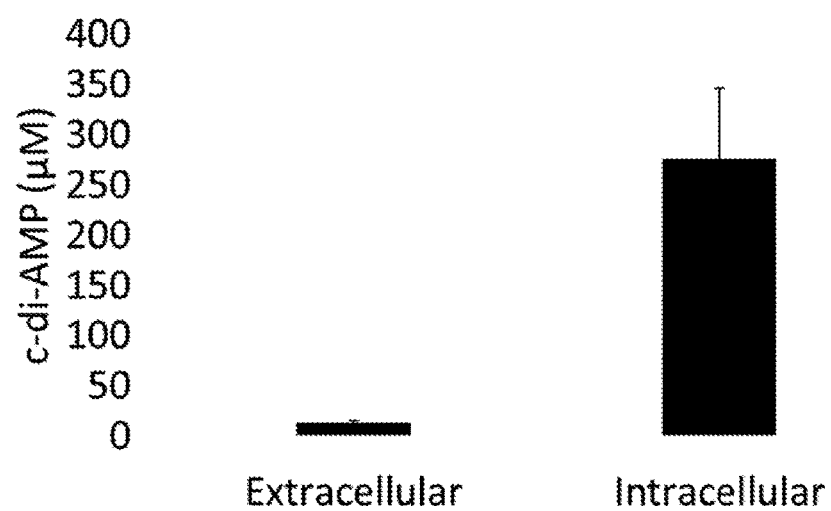
FIG. 42B depicts a bar graph showing extracellular and intracellular cyclic-di-AMP accumulation in vitro as measured by LC/MS. No cyclic-di-AMP accumulation was measured in control strains which do not contain the dacA expression construct.

Results are shown in FIG. 42B. and indicate that engineered strains were able to produce c-di-AMP intracellularly and, to a lesser extent, extracellularly. For the wild-type control, cyclic-di-AMP was not found in either the intracellular or extracellular fractions (data not shown).

Example 41. Bacterially Produced STING Agonists Induce the Immune Response

To determine whether bacterially produced STING agonists or the bacterial chassi themselves is responsible for induction of the immune response, live and heat-killed SYN3527 were added to the supernatant of RAW 267.4 mouse macrophage cell line and levels of IFN-beta1 mRNA were measured.

Figure 43:
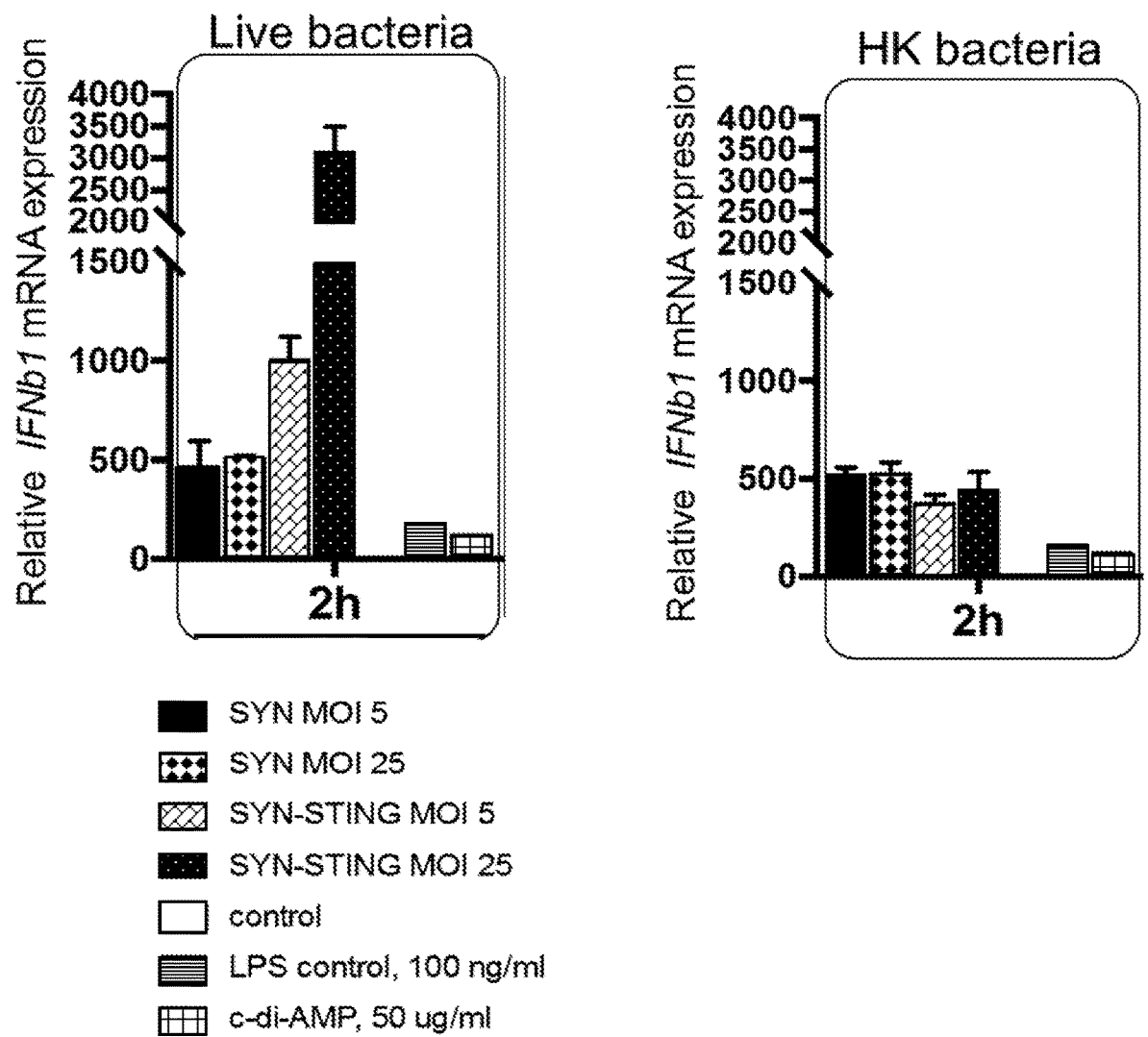
FIG. 43 depicts relative IFNb1 mRNA expression in RAW 267.4 cells treated with with live bacteria and heat killed bacteria.

As seen in FIG. 43, IFNb1 mRNA Expression Increases with c-di-AMP secreting strain dose-dependently, but not when heat killed.

Example 42. Activity of STING Agonist Producing Strain In Vivo

To determine the tolerability, colonization and activity of the STING agonist producing strain SYN3527 (*E coli* Nissle comprising plasmid-based, tetracycline-inducible p15a Ptet-DacA from *Listeria monocytogenes*, tumor volume, weight and T cell response was assessed in the B16 tumor model.

To produce cells for the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Figure 44A:
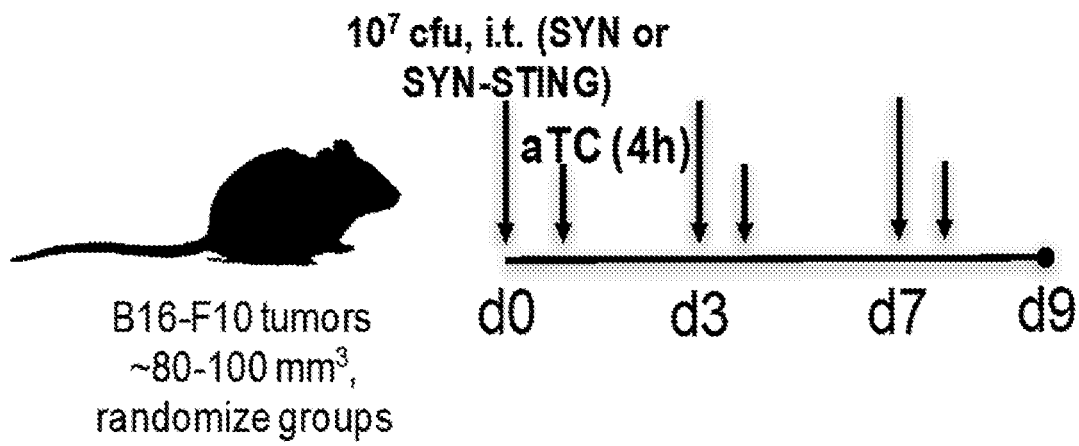
FIG. 44A depicts a schematic showing an outline of an in vivo mouse study, the results of which are shown in FIG. 44B and FIG. 44C.

Mice were implanted with B16 tumors, and mice injected intratumorally with bacteria producing STING agonists and controls, according to the time line described below and in FIG. 44A. Samples taken at various timepoints were processed for CFU counts per gram of tumor, cytokine analysis (IFN-beta and T cell panels) and flow cytometric analysis of tumor draining lymph nodes (TDLN).

Briefly, B16 cells were implanted (2×10e5 cells/mouse in PBS) SC into the right flank of each animal on day −9. On day Day −3 tumor growth was monitored; when the tumors reached ~50-80 mm^3 on day 1, mice were randomized into groups (N=15 per group/5 mice/timepoint) for intratumor dosing as follows: saline (control, group 1), SYN94 (streptomycin resistant Nissle, group 2, 1×10e7), and SYN3527 (STING Agonist, group 3, 1×10e7). Animals were dosed with appropriate bacteria based on group or saline (to control for injection). Four hours later, mice were treated with 10 ug ATC (anhydrotetracycline) via intraperitoneal injection. On day 2, 5 mice from each treatment group were sacrificed 5 mice/group (Group 1-4) 24 hours after ATC dose and samples were processed for analysis. On day 4, mice were weighed, tumor volumes were measured, and mice were dosed with the appropriate treatment/group. Four hours later, mice were injected with 10 ug ATC. On day 5, 5 mice/group were sacrificed 24 hours after the ATC dose. On day 8, the tumors in the remaining mice were weighed, measured and mice were dosed with appropriate treatment/group. On day 9, 5 mice/group were sacrificed for 24 hours after ATC dose.

Figure 44B:
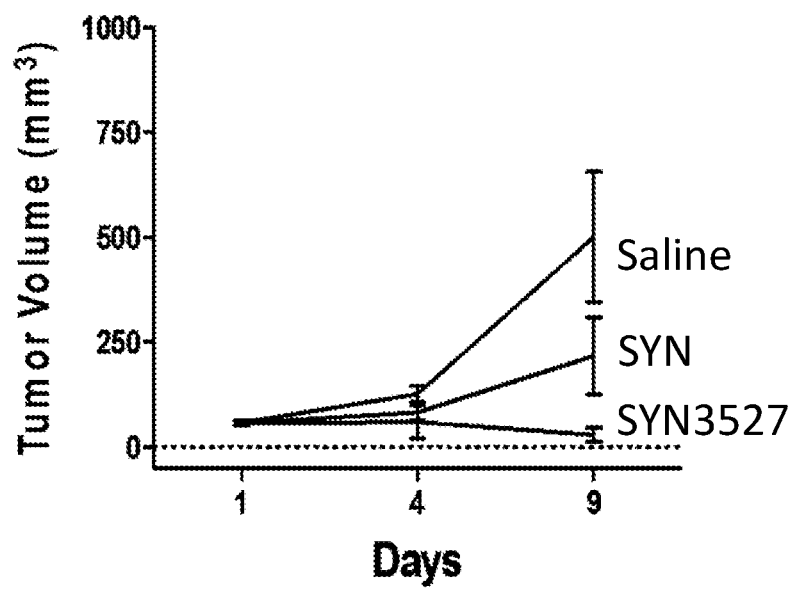
FIG. 44B depicts a line graph showing the average mean tumor volume of mice implanted with B16-F10 tumors and treated with saline, SYN94 (streptomycin resistant wild type Nissle) or SYN3527 (comprising the tetracycline inducible dacA construct).
Figure 44C:
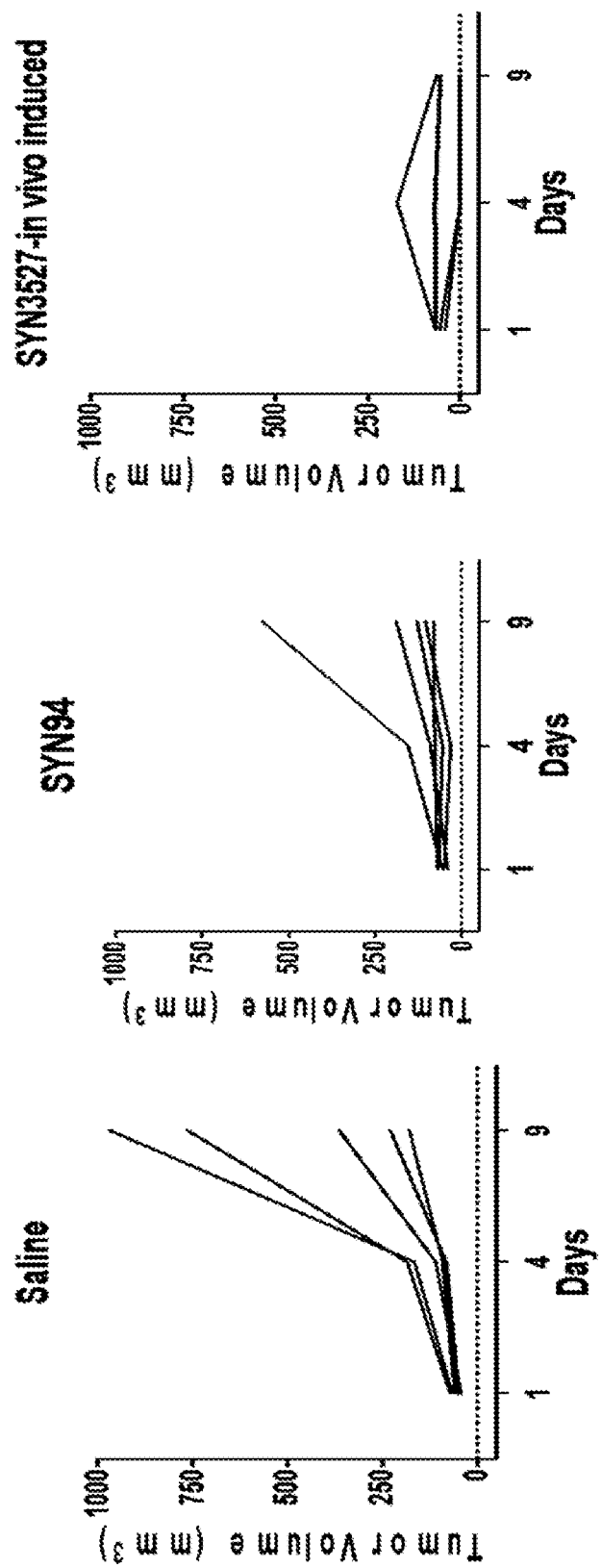
FIG. 44C depicts line graphs showing tumor volume of individual mice in the study.
Figure 44D:
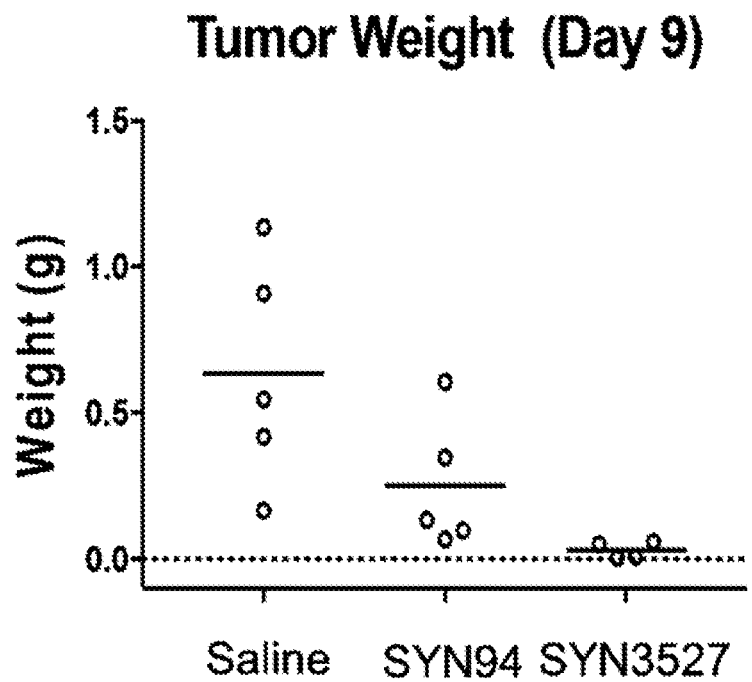
FIG. 44D depicts a graph showing the tumor weight at day 9.
Figure 44E:
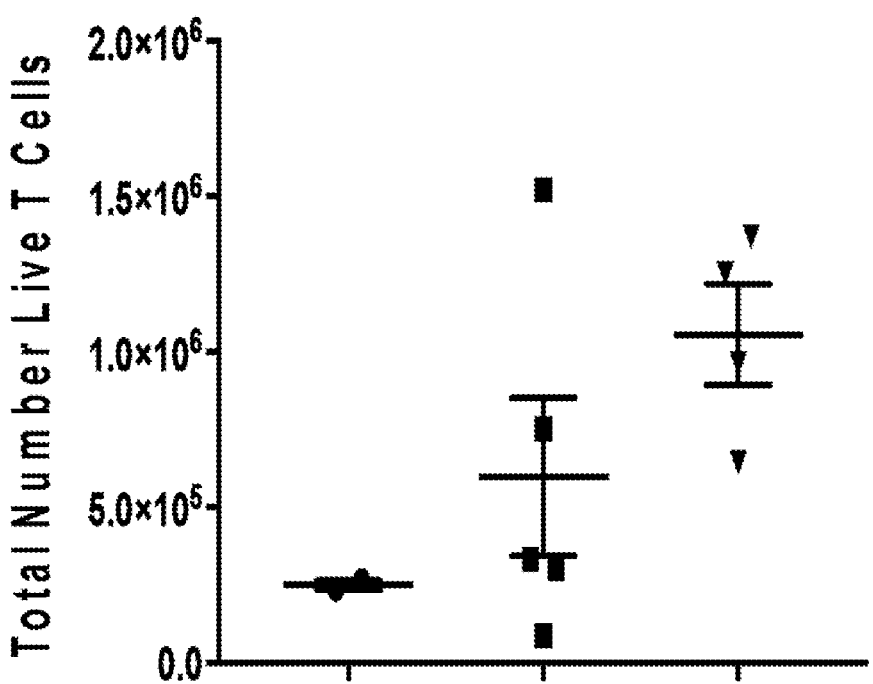
FIG. 44E depicts a graph showing total T cell numbers in the tumor draining lymph node at day 9 measured via flow cytometry.
Figure 44F:
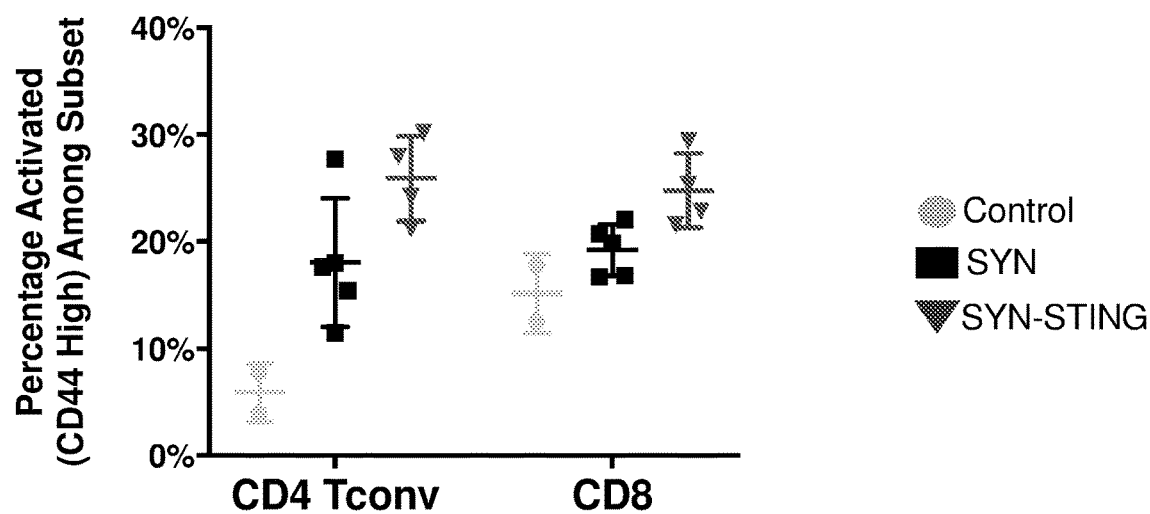
FIG. 44F depicts a graph showing percentage of activated (CD44 high) T cells among CD4 (conventional) and CD8 T cell subsets and FIG. 44G depicts a graph showing a lack of activation of Tregs upon STING injection in the tumor draining lymph node at day 9 as measured via flow cytometry.
Figure 44G:
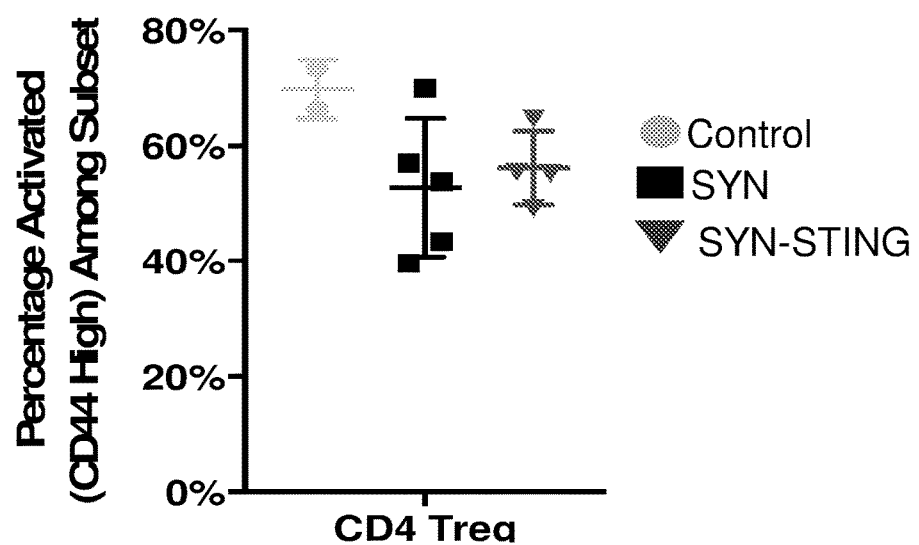
Figure 45A:
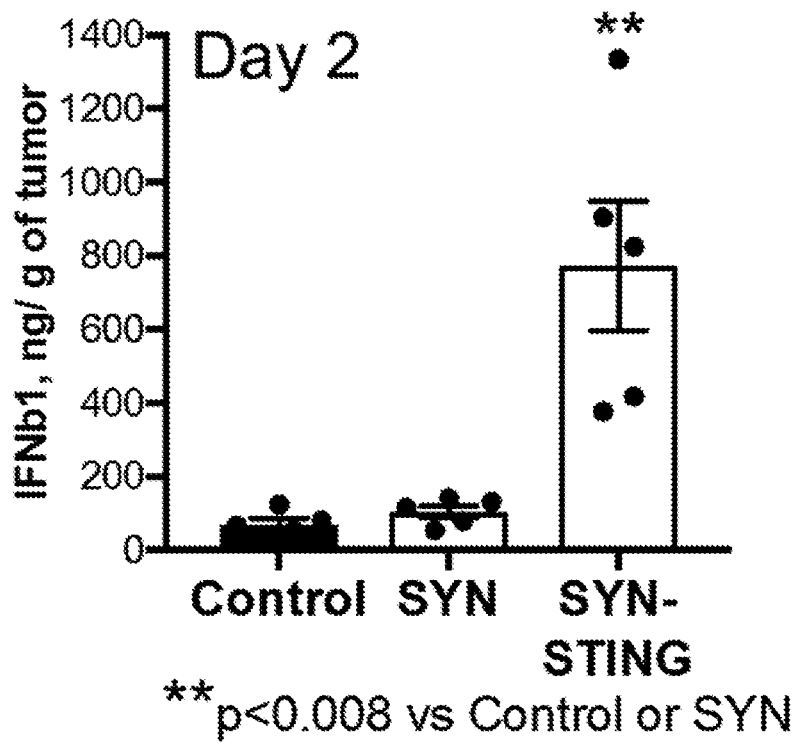
FIG. 45A and FIG. 45B depict bar graphs showing the concentration of IFN-b 1 in B16 tumors measured by Luminex Bead Assay at day 2 (FIG. 45A) or day 9 (FIG. 45B) after administration and induction of tet-inducible STING Agonist producing strain SYN3527 as compared to mice treated with saline or streptomycin resistant Nissle.
Figure 45B:
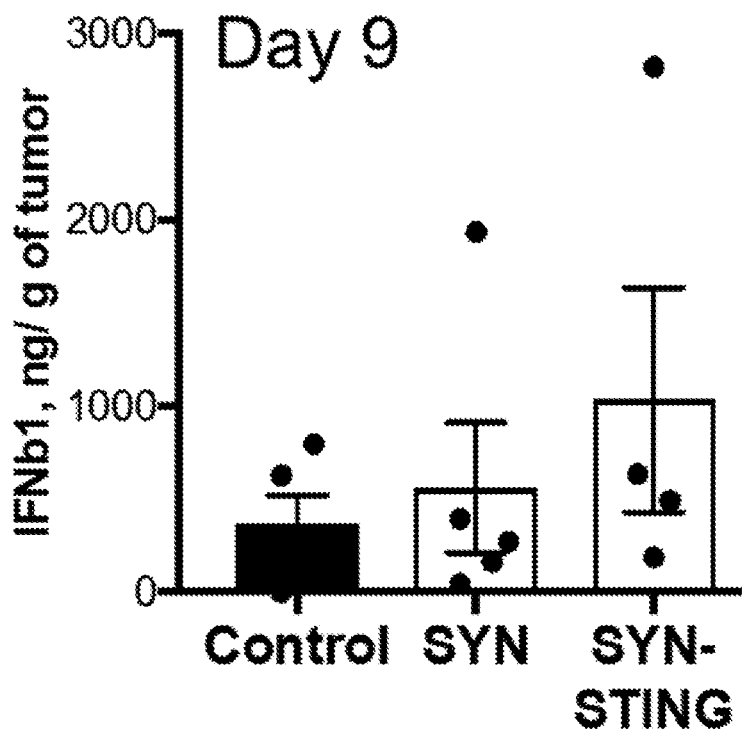
Figure 46A:
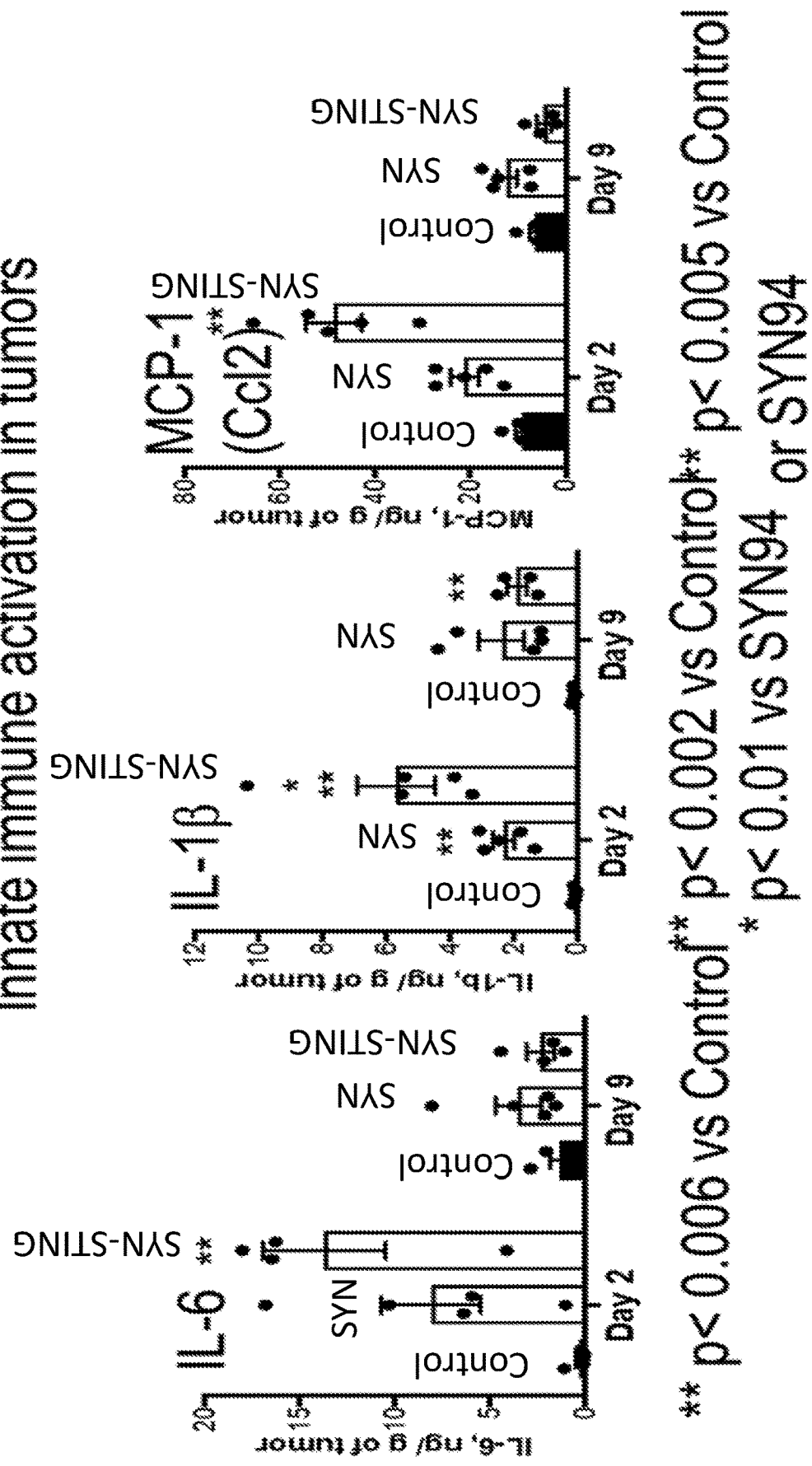
FIG. 46A depict bar graphs showing the concentration of IL-6 (left panel), IL-1beta (middle panel) and MCP-1 (right panel) in B16 tumors measured by Luminex Bead Assay at day 2 and 9 after administration and induction of tet-inducible STING Agonist producing strain SYN3527 as compared to mice treated with saline or streptomycin resistant Nissle.
Figure 46B:
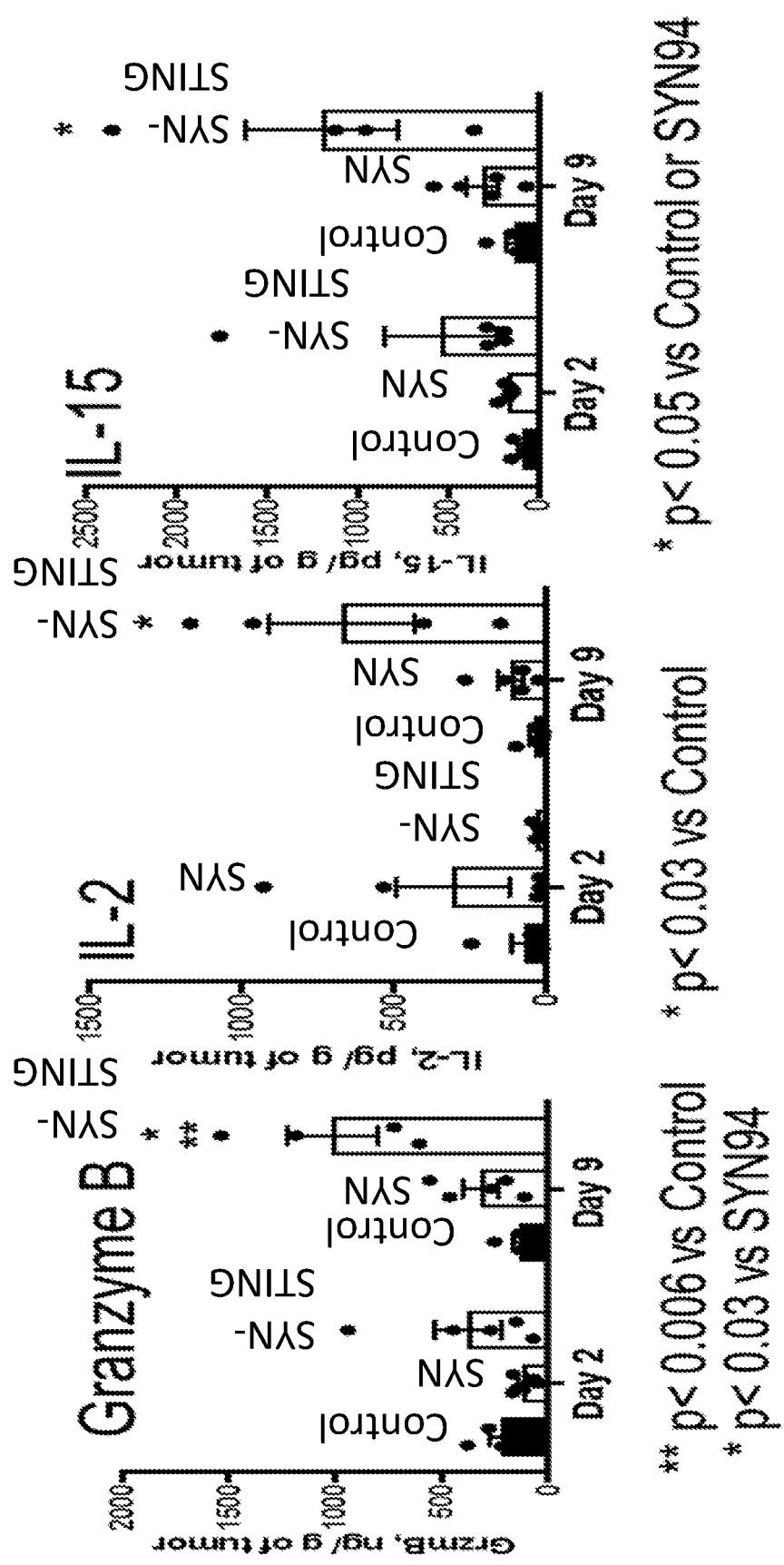
FIG. 46B depicts bar graphs showing the concentration of Granzyme B (left panel), IL-2 (middle panel) and IL-15 (right panel) in B16 tumors measured by Luminex Bead Assay at day 2 and 9 after administration and induction of tet-inducible STING Agonist producing strain SYN3527 as compared to mice treated with saline or streptomycin resistant Nissle. In both FIG. 46A and FIG. 46B, bars in each panel are arranged in the same order as in FIG. 45A and FIG. 45B, i.e, saline (left), streptomycin resistant wild type Nissle (middle) and SYN3527 (SYN-STING, right).

Tumor volume at day 1, 4, and 9 are shown in FIG. 44B and for individual mice in FIG. 44C and indicate that administration of SYN3527 results in rejection or control of tumor growth over this time period (p<0.02 for SYN3527 vs Saline Control on Day 9). Tumor weight shown in FIG. 44D at day 9 following administration of STING agonist producing bacteria shows significant tumor regression compared to saline control treatments (p<0.02). Flow cytometric analysis of lymphocytes from the tumor draining lymph node were performed by placing cells into single cell suspension and straining with the following antibodies: Anti-CD4-APC, TCR-beta-PECy7, CD8-alpha-BV785, CD25-BV650, and FoxP3-PE (all from Biolegend). Tumor regression correlates with an increase in total T cell numbers in the tumor draining lymph node (TDLN), as measured by flow cytometric analysis (p<0.03 for SYN3527 vs Saline Control), which may indicate activation and expansion of tumor specific T cells (FIG. 44E).

For cytokine analysis, a Luminex assay was performed according to manufacturer's instructions. To determine the activation of the innate immune system by the bacterially produced STING agonist, levels of INF-beta1, IL-6, IL-1beta, and MCP-1 (Ccl2)) were assessed and results for day 2 and day 9 are shown in FIG. 45A and FIG. 45B and FIG. 46A and FIG. 46B. Results indicate that STING agonists produced by SYN3527 are able to increase significantly the IFN-beta production at day 2 in the tumor (P<0.008 vs control or SYN94), as well as induce the general innate immune response over saline and Nissle alone at day 2, but not day 9, as shown by IL-6 (p<0.006 vs Control), TNF-alpha (** p<0.002 vs Control, * p<0.01 vs SYN94) and MCP-1 induction. The innate response within the tumor at day 2 was switched to a T-cell related response at day 9, as shown by the production of T-cell related cytokines granzyme B (p<0.006 vs Control; <0.03 vs SYN94, IL-2 (p<0.03 vs Control) and IL-15 (p<0.05 vs Control or SYN94) (FIG. 46B).]

Example 43. Activity of Adenosine Consuming Strain in Combination with Systemic Anti-PD-1 and Anti-CTLA-4 in MC38 Tumor Model The ability of the adenosine consuming strain SYN1656 to augment the anti-tumor response of combined anti-CTLA4 and anti-PD-1 was assessed in the C57BL/6-MC38 syngeneic tumor model.

To produce cells used in the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Mice were implanted with MC38 tumors, and mice injected intratumorally with the adenosine consuming bacteria and intraperitoneally with anti-CTLA-4 and anti-PD-1 antibodies according to the study design in Table 54. MC38 cells were implanted (1×105/mouse/100 μL) SC into the right flank of each animal on day −9. Tumor growth was monitored; when the tumors reached ~50-80 mm^3 on day 1, mice were randomized into treatment groups as shown in Table 54.

Tumor volumes and body weights were recorded three times in a week with a gap of 1-2 days in between two measurements.

Results show that the adenosine consuming strain has the ability to improve anti-CTLA-4/anti-PD-1 antibody-mediated anti-tumor activity in the MC38 model. Specifically, in the anti-PD-1/anti-CTLA-4 group, 5 out of 12 mice responded to the treatment, including 1 out of 12 with a complete response. In the anti-PD-1/anti-CTLA-4 plus SYN1656 group, the same number (5 out of 12) responded, but at least 4 out of 5 responders were complete responders.

Example 44. Generation of a Strain for the Conversion of 5-FC to 5-FU

5-FU is a common chemotherapeutic limited by its systemic toxicity. However, 5-FC is much better tolerated. Using codA (cytosine deaminase) or a fusion of the codA (cytosine deaminase) and upp (uracil phosphoribosyltransferase), 5-FC can be converted into active drug form—5F-UMP—in the tumor, minimizing associated side effects.

To generate 5-FU producing strains, codA (cytosine deaminase) or a fusion of the codA (cytosine deaminase) and upp (uracil phosphoribosyltransferase) was cloned into a p15 vector under the control of the Ptet promoter; to generate the strain as described in Table 58.

TABLE 58

| Strain: | Genotype |
|---|---|
| SYN3529 | Nissle pUC-Kan-tet-CodA (cytosine deaminase) |
| SYN3620 | Nissle p15A Ptet-CodA::Upp fusion |

Example 45. In Vitro Conversion of 5-FC to 5-FU

The ability of the newly generated strain to convert 5-FC to 5-FU was first assessed in vitro.

*E. coli* Nissle strains SYN3529, SYN3620 described above and SYN94 control (wild type Nissle with streptomycin resistance), were grown overnight in LB medium.

TABLE 54

Study design

| Group | N | Treatment 1 | | | | Treatment 2 | | | | Treatment 3 Compound |
|---|---|---|---|---|---|---|---|---|---|---|
| | | Test Article | Route | Dose | Schedule | Test Article | Route | Dose | Schedule | |
| 1 | 12 | Anti-PD-1 Isotype Control | i.p. | 200 ug | Day 2, 5, 8, 11, 14, 17, 20 | Anti-CTLA-4 Isotype Control | i.p. | 100 ug | Day 2, 5, 8, 11, 14, 17, 20 | NA |
| 2 | 12 | Anti-PD-1 | i.p. | 200 ug | Day 2, 5, 8, 11, 14, 17, 20 | Anti-CTLA-4 | i.p. | 100 ug | Day 2, 5, 8, 11, 14, 17, 20 | NA |
| 3 | 12 | Anti-PD-1 | i.p. | 200 ug | Day 2, 5, 8, 11, 14, 17, 20 | Anti-CTLA-4 | i.p. | 100 ug | Day 2, 5, 8, 11, 14, 17, 20 | SYN094, 5e6 bacteria, i.t., BIWx3 Starting on Day 1 |
| 4 | 12 | Anti-PD-1 | i.p. | 200 ug | Day 2, 5, 8, 11, 14, 17, 20 | Anti-CTLA-4 | i.p. | 100 ug | Day 2, 5, 8, 11, 14, 17, 20 | SYN825, 5e6 bacteria, i.t., BIWx3 Starting on Day 1 |
| 5 | 12 | Anti-PD-1 | i.p. | 200 ug | Day 2, 5, 8, 11, 14, 17, 20 | Anti-CTLA-4 | i.p. | 100 ug | Day 2, 5, 8, 11, 14, 17, 20 | SYN1656, 5e6 bacteria, i.t., BIWx3 Starting on Day 1 |

Cultures were diluted 1:50 in M9 minimal media supplemented with 0.5% glucose (w/v) and grown shaking (350 rpm) at 37° C. for 2 hours, at which time anhydrous tetracycline (ATC) was added to cultures at a concentration of 100 ng/mL to induce expression of CodA or CodA-Upp fusion. After 2 hours of induction, cultures were spun down, media was aspirated and the cell pellets were resuspended into M9+0.5% glucose (w/v)+ATC (100 ng/mL)+10 mM 5-fluorocytosine (Sigma-Aldrich®). These cultures were then returned to the 37° C. incubator and allowed to incubate with shaking for additional 2 hours at which point samples were removed for LC/MS analysis of 5-FU production. Samples were centrifuged for 20 minutes at 5000 RPM to separate cellular and extracellular fractions. Cell pellets were then used to determine intracellular 5-FC and 5-FU and the media supernatants were used to determined extracellular accumulation of 5-FU or consumption of 5-FC.

Figure 47A:
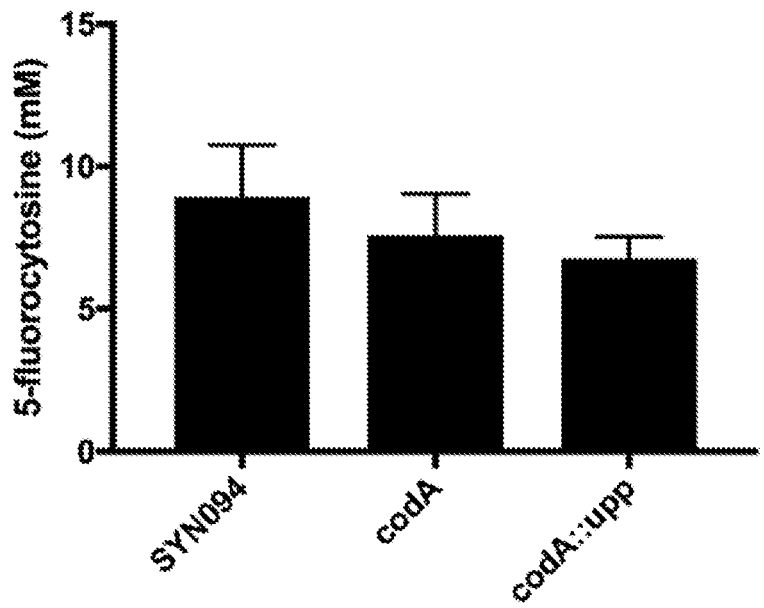
FIG. 47A and FIG. 47B depict bar graphs the ability of the E. coli Nissle strains SYN3529 (Nissle p15A Ptet-CodA) and SYN3620 (Nissle p15A Ptet-CodA::Upp fusion) to convert 5-FC to 5-FU. The graphs show 5-FC levels (FIG. 47A) and 5-FU levels (FIG. 47B) after an assay time of 2 hours.
Figure 47B:
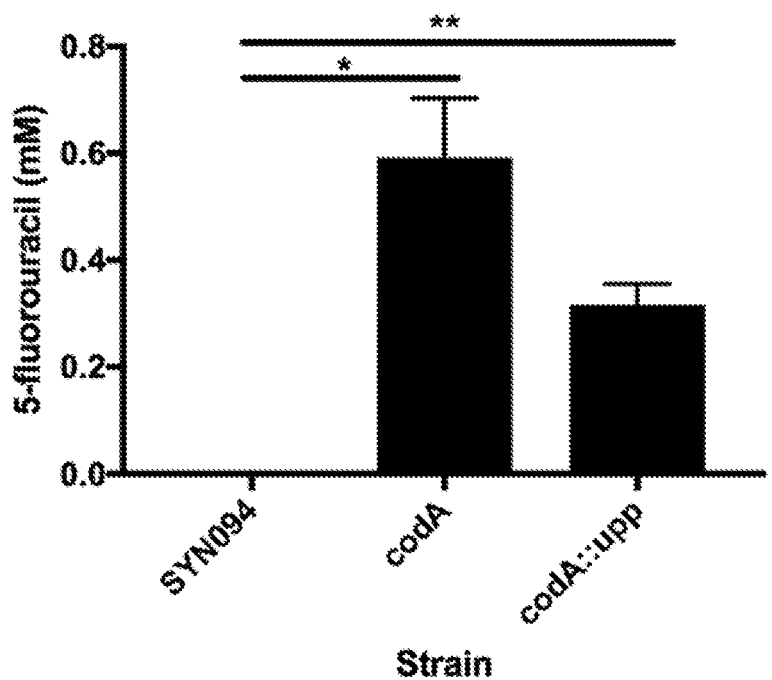
Figure 48A:
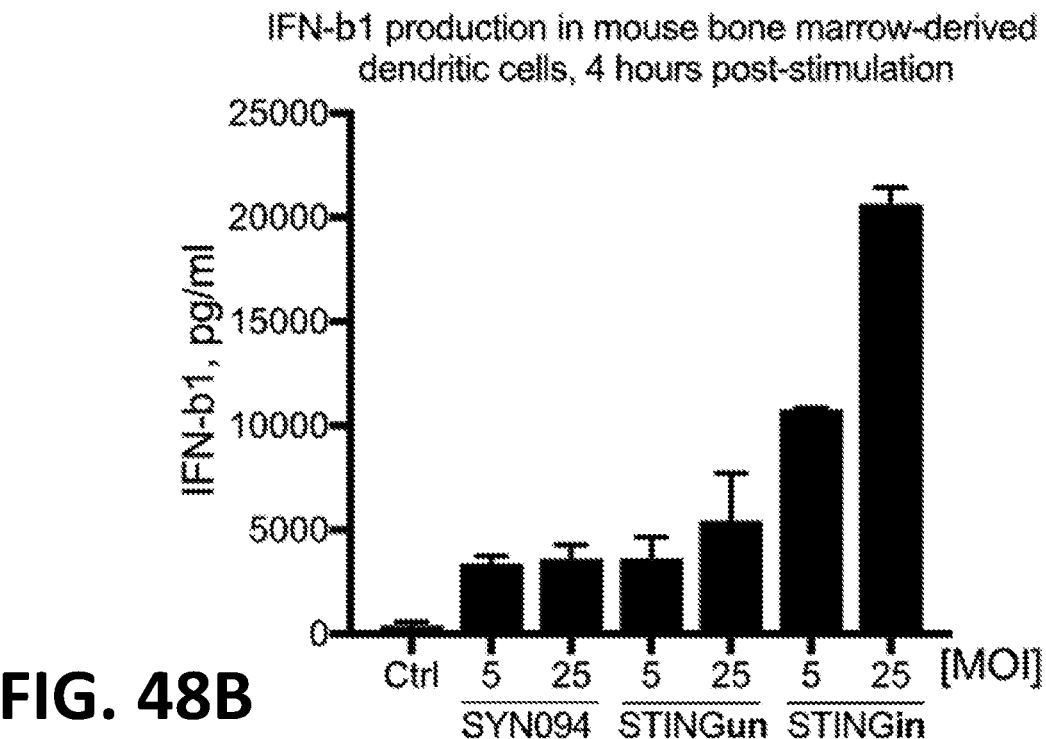
FIG. 48A and FIG. 48B depicts graphs showing INF-b 1 production (FIG. 48A) or IFN-b1 mRNA expression (FIG. 48B) in mouse bone marrow derived dendritic cells either at 4 hours post stimulation (FIG. 48A) or at 2 and 4 hours post stimulation (FIG. 48B) with SYN3527 (comprising tetracycline-inducible DacA from *Listeria monocytogenes*). SYN3527 was either left uninduced ("STINGun") or induced with tetracycline "STINGin" prior to the experiment.
Figure 48B:
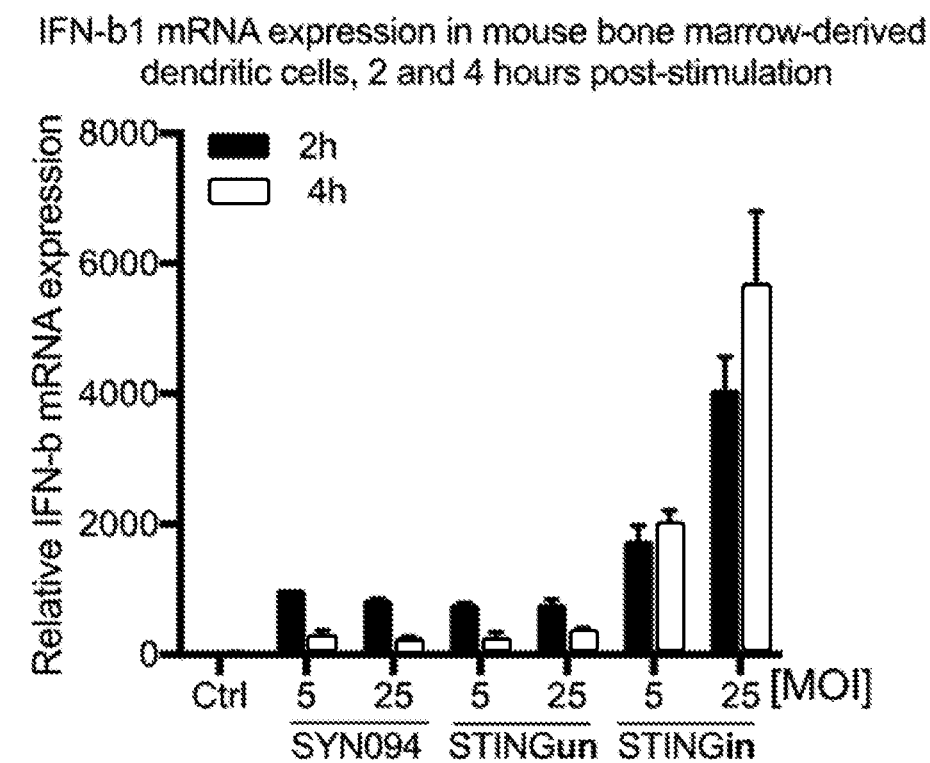

Results are shown in FIG. 47A and FIG. 47B. and indicate that engineered strains were able to degrade 5-FC (FIG. 47A) and to produce 5-FU (FIG. 47B) at a rate higher than that of the wild type control strain. Since there was no available standard for 5-FUMP, we were unable to measure the accumulation of 5-FUMP from SYN3620.

Example 45. In Vivo Activity of 5F-C to 5-FU Converter in the CT26 Tumor Model

To determine In Vivo activity and efficacy of 5-FC to 5-FU converting strains SYN3529 (comprising pUC-Kan-tet-CodA (cytosine deaminase)) and SYN3620 (comprising pUC-Kan-tet-CodA::Upp fusion), tumor volume was assessed and compared to PBS control in the CT26 tumor model.

To produce cells for the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Figure 49A:
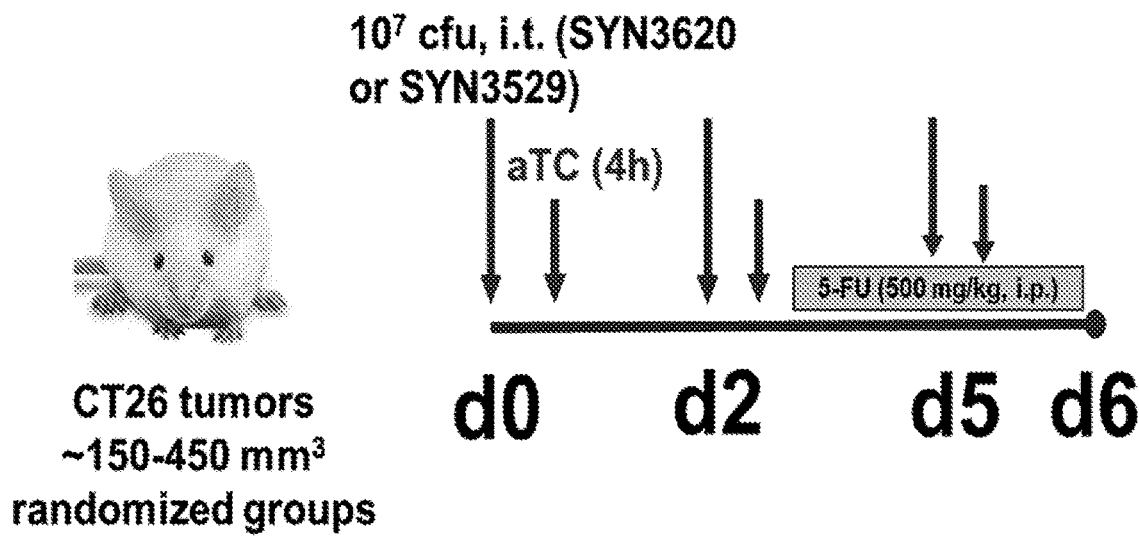
FIG. 49A depicts a schematic showing an outline of an in vivo mouse study, the results of which are shown in FIG. 49B, FIG. 49C, FIG. 49D, and FIG. 49E.

Mice were implanted with CT26 tumors, injected intratumorally with bacteria producing enzymes capable of converting 5-FC into 5-FU or vehicle control, and dosed with 5-FC according to the time line described below and in FIG. 49A. Tumor volumes were measured at various time points, while tumors were weighed and processed at the conclusion of the experiment to evaluate relative consumption of 5-FC as a measure of the strains bioactivities.

Briefly, CT26 cells were implanted (1×10^6 cells/mouse in PBS) SC into the right flank of each animal on day −15. Tumor growth was monitored until the tumors reached ~150-450 mm^3. On day 0, mice were randomized into groups (N=5 per group) for intratumor dosing as follows: PBS (group 1, vehicle control), SYN3529 (group 2, 1×10^7 CFU), SYN3620 (group 3, 1×10^7 CFU). Tumor sizes were measured and mice were injected I.T. with bacteria or PBS on day 0, 2, and 5, followed by ATC (1 ug I.P.) 4 hours later. Starting on day 3, 5-FC (500 mg/kg) was administered daily via IP injection. Mice were sacrificed on day 6 for final analysis.

Figure 49B:
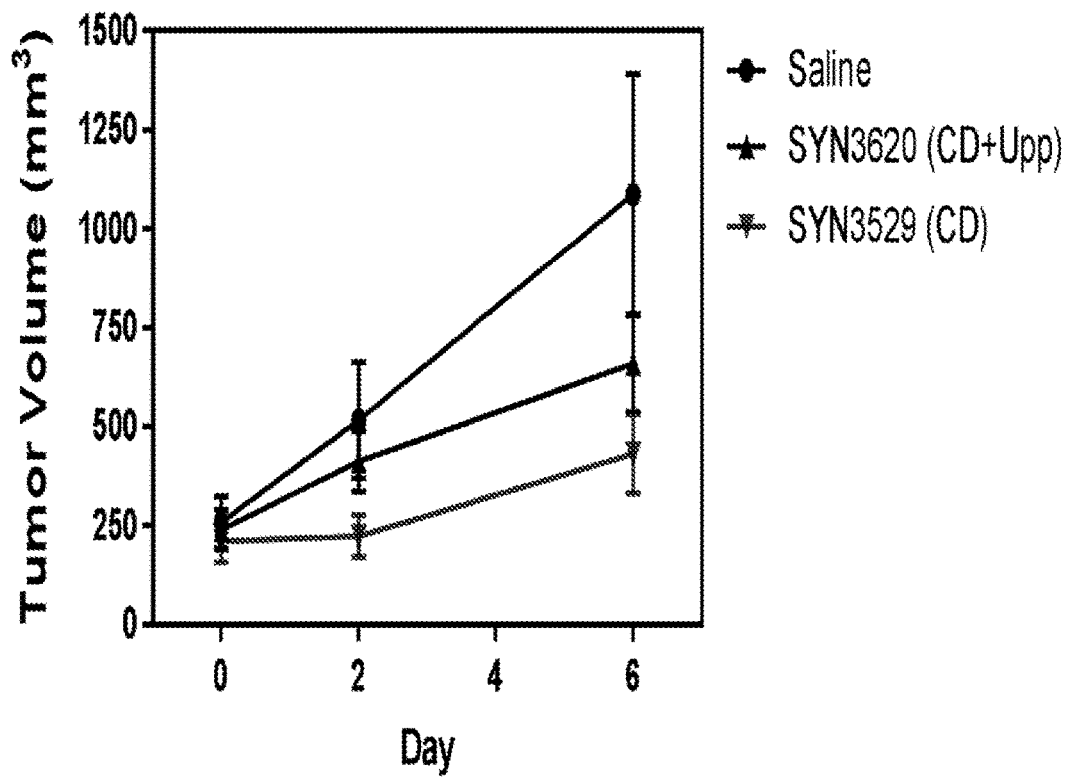
FIG. 49B depicts a line graph showing the average mean tumor volume of mice implanted with B16-F10 tumors and treated with PBS, SYN3620 (comprising pUC-Kan-tet-CodA::Upp fusion) or SYN3529 (comprising pUC-Kan-tet-CodA (cytosine deaminase)).
Figure 49C:
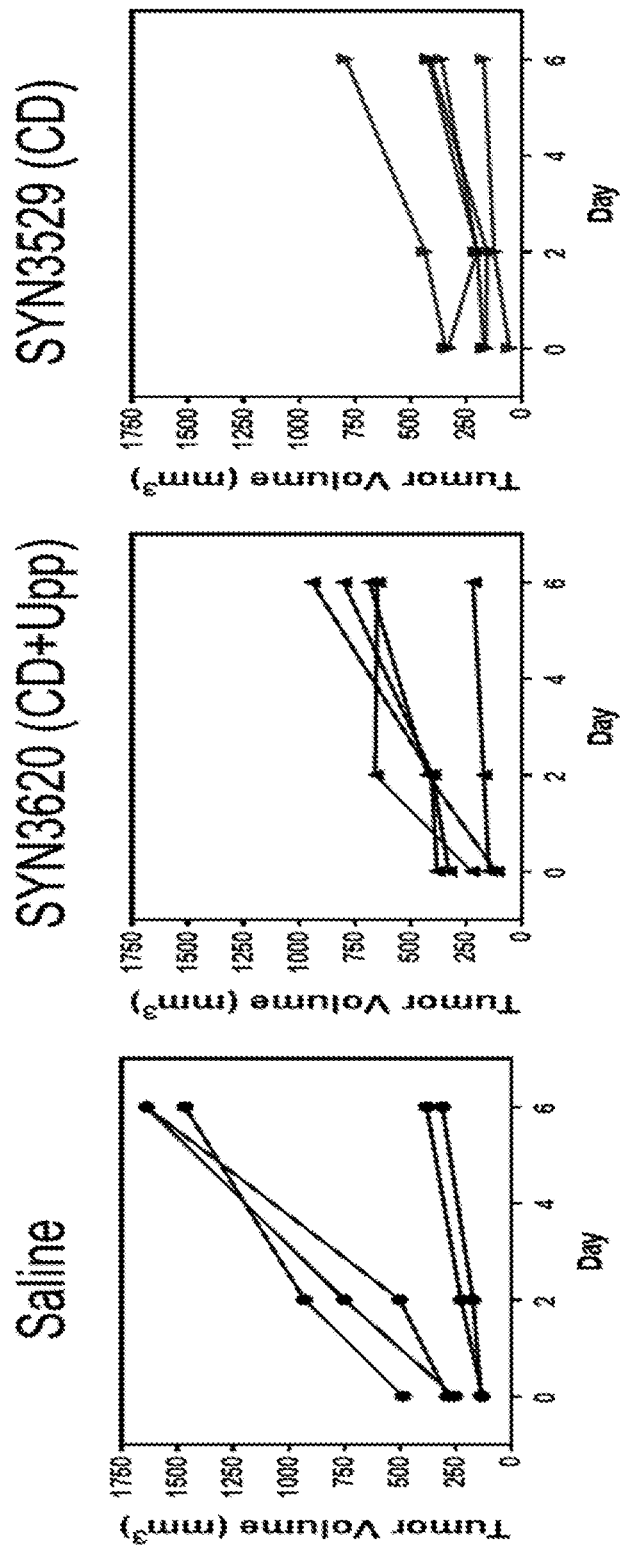
FIG. 49C depicts line graphs showing tumor volume of individual mice in the study.
Figure 49D:
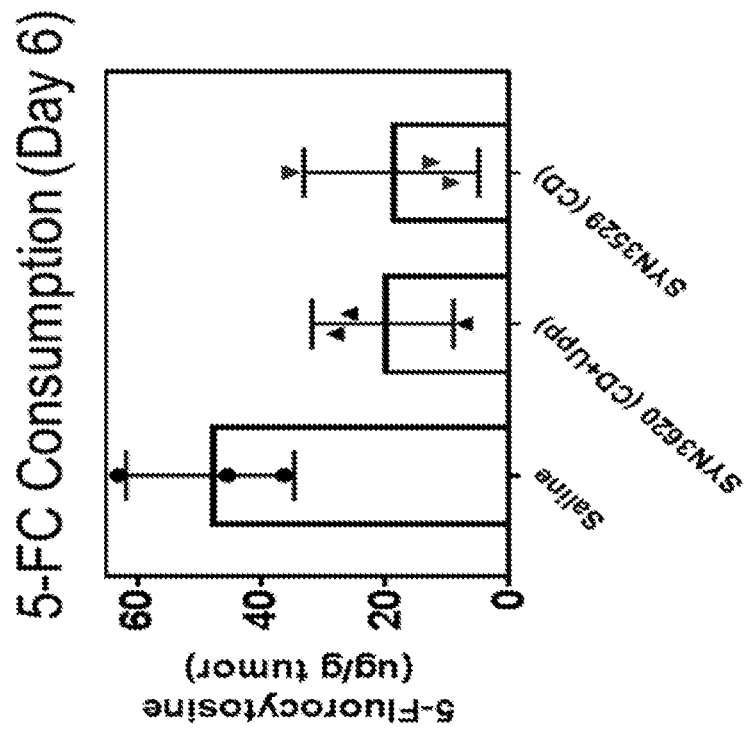
FIG. 49D depicts a graph showing the tumor weight at day 6.
Figure 49E:
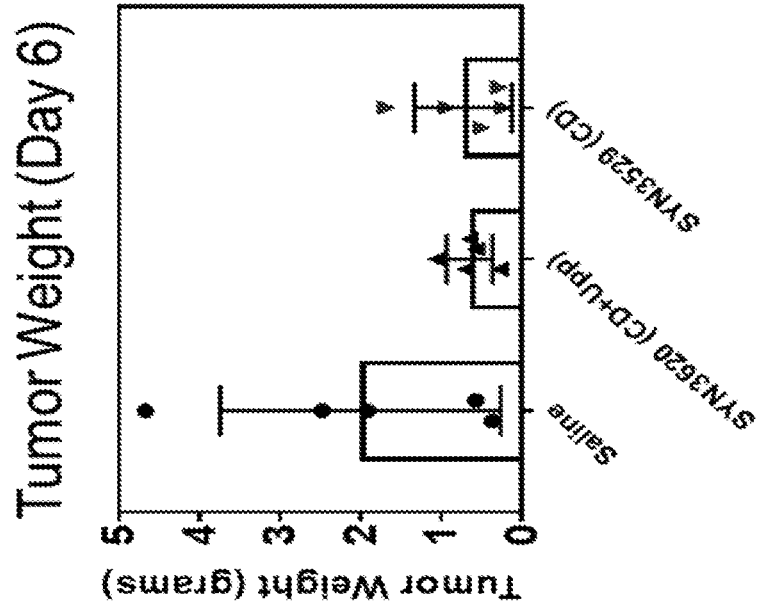
FIG. 49E depicts a graph showing intratumoral concentration of 5-FC at day 6 measured via mass spectrometry.

Average tumor volumes at day 0, 2, and 5 are shown in FIG. 49B and for individual mice in FIG. 49C, and indicate that administration of either SYN3529 or SYN3560 alongside 5-FC results in a blunting of tumor growth over this time period compared to PBS control. Tumor weight shown in FIG. 49D at day 6 following administration of bacteria, day 3 post 5-FC dosing, shows reduction in tumor mass compared to PBS control treatments. Mass spectrometry analysis of tumor homogenates demonstrate a reduction in 5-FC levels for bacterially colonized tumors compared to PBS controls, suggesting in situ conversion of 5-FC to its active form 5-FU (FIG. 49E).

Example 46. Generation of a Combined Kynurenine Consumer and a STING Agonist Producer and In Vitro Measurement of Strain Activity To generate a strain that consumes kynurenine and produces a STING agonist, SYN2028 (comprising Nissle HA3/4::PSynJ23119-pKynase TrpE::CmR) was transformed with the construct previously used in SYN3527 (DacA cloned into a p15 vector under the control of the Ptet promoter); to generate the strain as described in Table 57.

TABLE 57

| Strain: | Genotype |
| --- | --- |
| SYN2028 | Nissle HA3/4::PSynJ23119-pKynase TrpE::CmR |
| SYN3527 | Nissle p15A Ptet-DacA (listeria monocytogenes cyclic di AMP |
| SYN3831 | Nissle HA3/4::PSynJ23119-pKynase TrpE::CmR; p15a Ptet - DacA |

Next, the ability of the newly generated strain to consume kynurenine and to produce a STING agonist was assessed in vitro. E. coli Nissle strains SYN094 (wild-type control), SYN2028 (KYN), SYN3527 (STING) and SYN3831 (KYN+STING) were grown overnight in LB medium containing appropriate antibiotics. Cultures were diluted 1:25 in M9 minimal media supplemented with 0.5% glucose (w/v) and appropriate antibiotics or LB and antibiotics and grown shaking (350 rpm) at 37° C. for 2 hours.

For measurement of cyclic-di-AMP production, cultures in the M9 media were diluted with the same M9 supplemented media to an optical density (600 nm) of 0.5 at which time anhydrous tetracycline (ATC) was added to cultures at a concentration of 100 ng/mL to induce expression of DacA. Cells were induced for a further 4 hours to allow accumulation of cyclic-di-AMP.

Samples were removed for LC/MS analysis of cyclic dinucleotide production. Samples were centrifuged for 5 minutes at 10000×g to separate cellular and extracellular fractions. Cell pellets were then used to determine intracellular cyclic-di-AMP. Concentrations were determined via LC/MS.

For quantifying kynurenine consumption, the LB cultures were spun down and resuspended in LB with 100 μM L-kynurenine (Sigma-Aldrich®) to an optical density (600 nm) of 1.0. These cultures were then placed at 37° C. with shaking for 4 hours to allow consumption of kynurenine. For kynurenine consumption measurements, samples were removed from each culture and spun for 5 minutes at 10000×g to separate the cellular and extracellular fractions. Media supernatant was removed and used to determine consumption of kynurenine via LC/MS analysis.

Figure 50A:
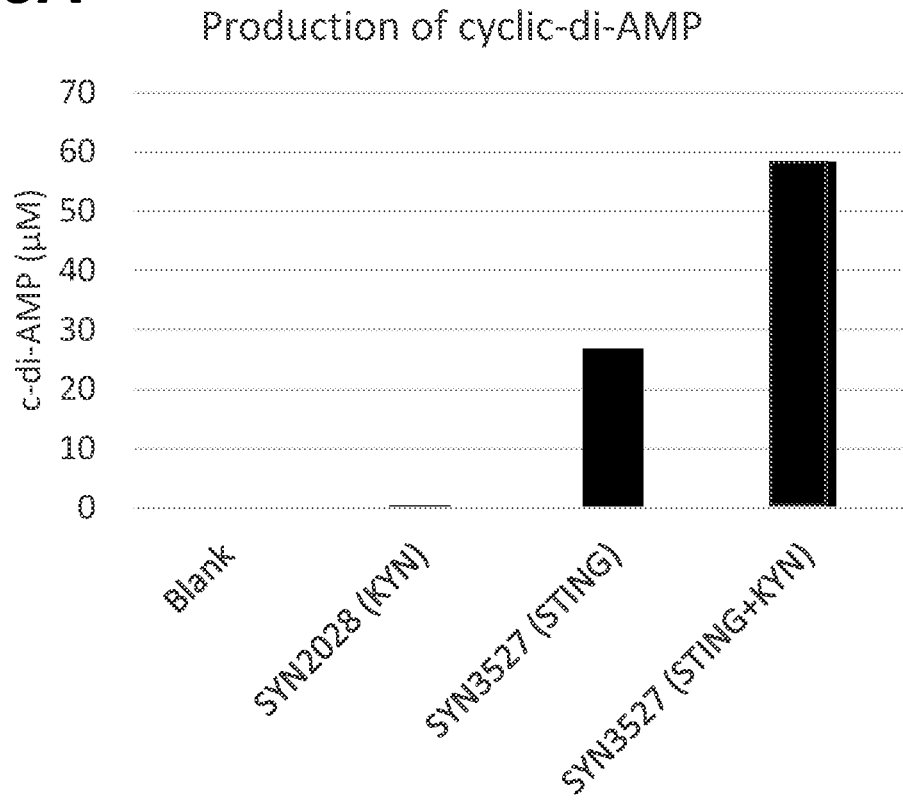
FIG. 50A and FIG. 50B depicts bar graphs showing production of cyclic0di-AMP (FIG. 50A) and consumption of kynurenine (FIG. 50B) for STING agonist producer SN3527, kynurenine consumer SYN2028, and combination strain (STING agonist producer plus kynurenine consumer) SYN3831.
Figure 50B:
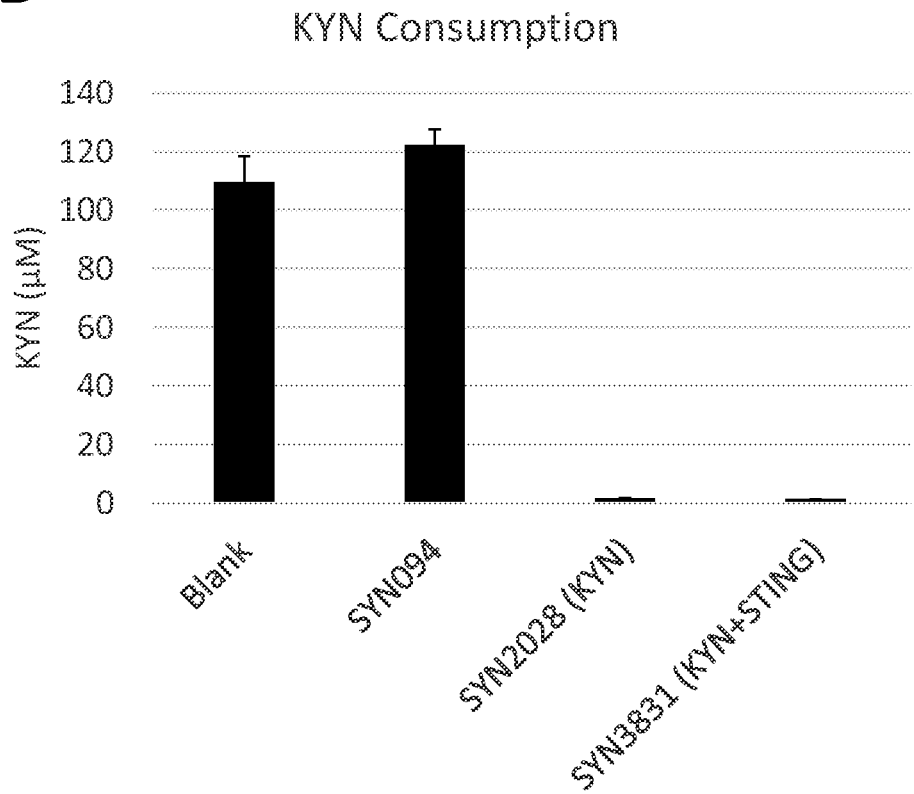

Results shown in FIG. 50A indicate that the engineered strain SYN3831 was able to produce cyclic-di-AMP similar to SYN3527, where it's kynurenine-consuming parent, SYN2028, was not able to produce cyclic-di-AMP. Results of FIG. 50B indicate that the new combo strain SYN3831 also retained the ability to consume kynurenine similarly to it's parent SYN2028. Taken together these results support that in vitro the combo strain SYN3831 possesses the ability to both produce the STING agonist cyclic-di-AMP, as well as consume the AHR agonist, kynurenine.

Example 47. Functional Assay for Secreted IFN-Gamma

Next, studies were conducted to demonstrate that IFN-gamma secreted from genetically engineered bacteria is functional. A cell-based assay was employ based on increased phosphorylation of STAT1 upon binding of IFN-gamma to its receptor. Bioactivity of IFN-gamma can be determined by quantification of STAT1 phosphorylation via flow cytometry.

Next, studies were conducted to demonstrate that IFN-gamma secreted from genetically engineered bacteria is functional. A cell-based assay was employ based on increased phosphorylation of STAT1 upon binding of IFN-gamma to its receptor. Bioactivity of IFN-gamma can be determined by quantification of STAT1 phosphorylation via flow cytometry.

Briefly, mouse RAW264.7 cells were treated with supernatants from murine IFNg expressing bacteria (SYN3543 comprising PAL::Cm p15a Ptet-87K PhoA—mIFNg) for 15 min. Treated cells were fixed in paraformaldehyde based solution followed by harsh permeabilization in 90% methanol. Modulation of phospho-STAT1 was quantified by flow cytometry, and results are shown in FIGS. 57A and 57B.

Figure 57A:
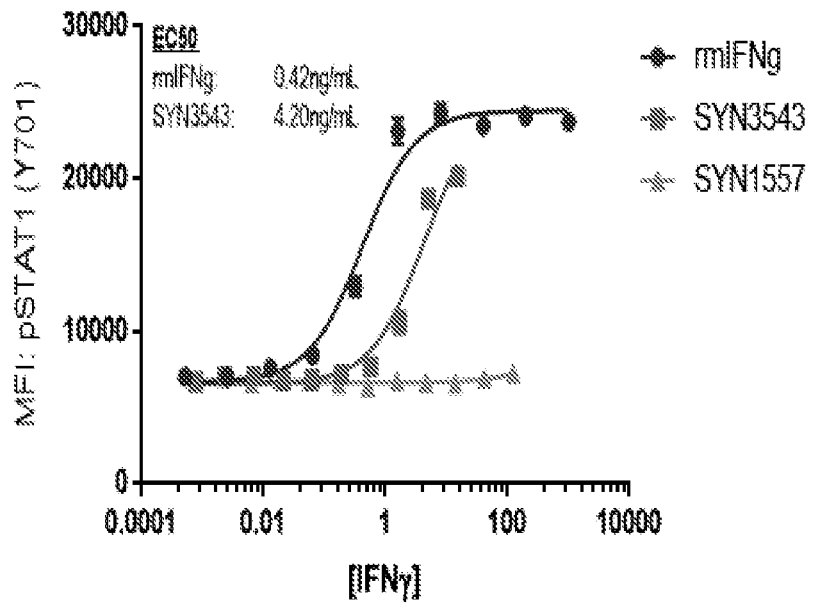
FIG. 57A and FIG. 57B depict graphs showing results of a cell based assay showing STAT1 phosphorylation in mouse RAW264.7 cells upon treatment with supernatants of the IFNgamma secreter SYN3543 (PAL::Cm p15a Ptet-87K PhoA-mIFNg), the parental control SYN1557, and a recombinant IL-15 control.
Figure 57B:
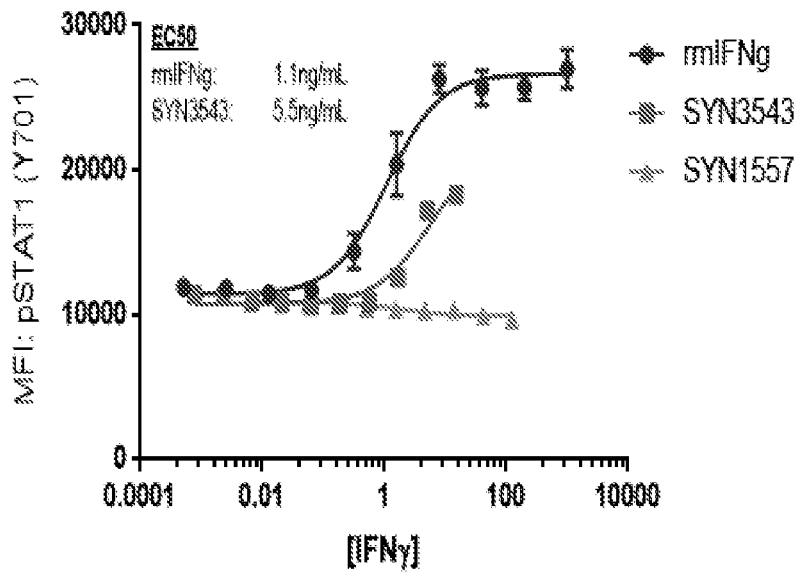

FIG. 57A and FIG. 57B, shows bioactivity of SYN3543 in two independent assays.

Example 48. Activity of CD40L Secreting Strain SYN3367 In Vivo

Figure 51A:
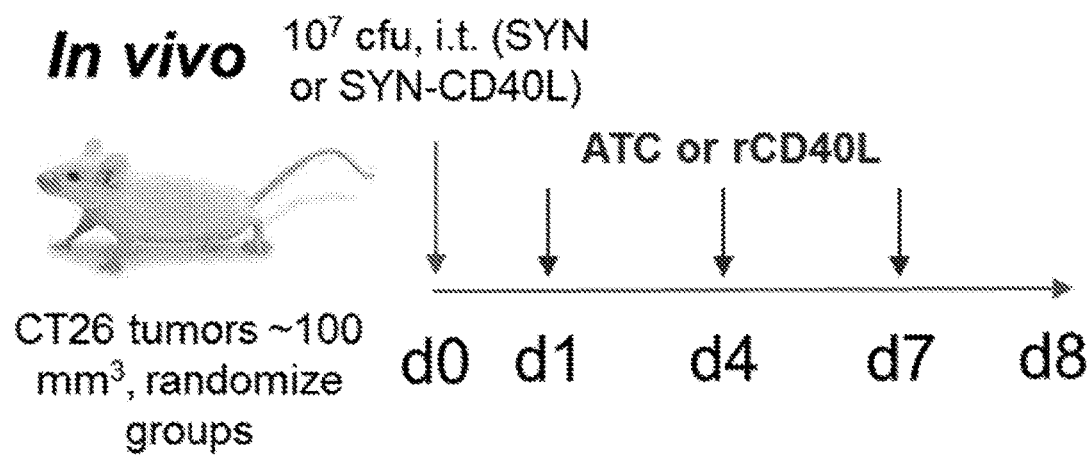
FIG. 51A depicts a schematic showing an outline of an in vivo mouse study, the results of which are shown in FIGS. 51B and 51C.

To determine the In Vivo activity of the CD40L secreting strain SYN3367 (comprising PAL::Cm pUC-tet-PhoA-mCD40L 112-260; referred to in this Example and FIG. 51 as SYN-CD40L), intratumoral antigen presenting cell (APC) activation was assessed by flow cytometry and compared to treatment with either SYN1557 (DOM mutant; referred to in this Example and FIG. 51 as SYN) or recombinant mouse CD40L (R&D Systems) in the CT26 tumor model.

To produce bacterial cells for the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration-tested by serial plating.

Briefly, CT26 cells were implanted ($1\times10^6$ cells/mouse in PBS) SC into the right flank of each animal. Tumor growth was monitored; when the tumors reached ~80-100 mm^3, mice were randomized into groups (N=6 per group) for intratumor dosing as follows: SYN1557 (leaky phenotype DOM mutant, group 1, $1\times10^7$), SYN3367 (mCD40L secreter, group 2, $1\times10^7$), and recombinant mCD40L (1 ug; Group 3). On day 0, mice were injected I.T. with bacteria. On day 1, 4, and 7, all groups were injected with 1 ug of ATC via IP injection (in three pulses). On day 1, 4, and 7, Group 3 was treated with 1 ug recombinant CD40L via I.T. injection. On day 8, all mice were sacrificed with 3 mice utilized to analyze activation of intratumoral APCs via flow cytometry and 3 mice utilized to measure bacterial colonization via CFU plating.

Figure 51B:
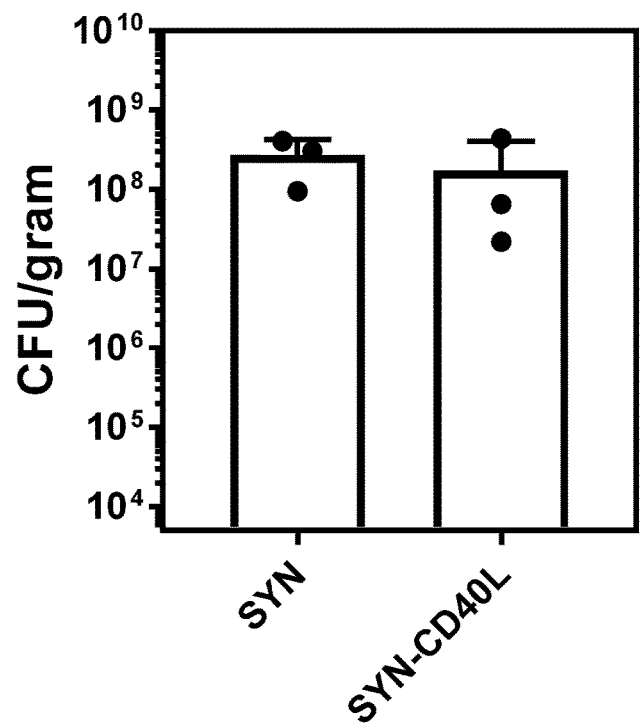
FIG. 51B depicts graphs showing bacterial colonization of tumors as measured by colony forming units (CFU).

Three representative tumors were homogenized, tumor homogenates were serially diluted and plated on LB Agar plates containing the appropriate antibiotics in order to measure the colony forming unit concentration. As depicted in FIG. 51B, SYN-CD40L colonized tumors to a similar extent as SYN reaching up to $1\times10^8$ CFUs/gram tumor. Flow cytometric analysis of intratumoral APCs from three representative tumors were performed by digesting tumors in a mixture of DNAse and Liberase TL (Sigma) for 30 minutes at 37° C., placing cells into single cell suspension and straining with the following antibodies: Anti-MHCII(IA/IE), CD45.2, CD40, Gr1, CD197(CCR7), CD11b, CD11c (all from Biolegend). Treatment of CT26 tumors with SYN-CD40L resulted in higher levels of CCR7 expression on intratumoral dendritic cells (p<0.04 for SYN-CD40L vs. SYN control) with a trend towards higher expression on macrophages as well (FIG. 51C). Additionally, a trend towards higher expression for CD40 was observed on both dendritic cells and macrophages in the tumor. These results suggest that treatment with SYN-CD40L results an increased activation of critical APC subsets within the tumor.

Example 49. Activity of hTNFa in CT26 Tumors

To determine In Vivo activity of hTNFa expressing strain SYN2304 (comprising PAL::CM p15a TetR Ptet-PhoA-TNFalpha; referred to in this Example and FIG. 52 as SYN-TNFα) tumor volume was assessed and compared to SYN1557 (DOM mutant; referred to in this Example and FIG. 52 SYN) in CT26 tumors.

To produce bacterial cells for the study, overnight cultures were used to inoculate 500 mL LB medium with antibiotic. The strains were incubated with shaking at 37 C until the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Figure 52A:
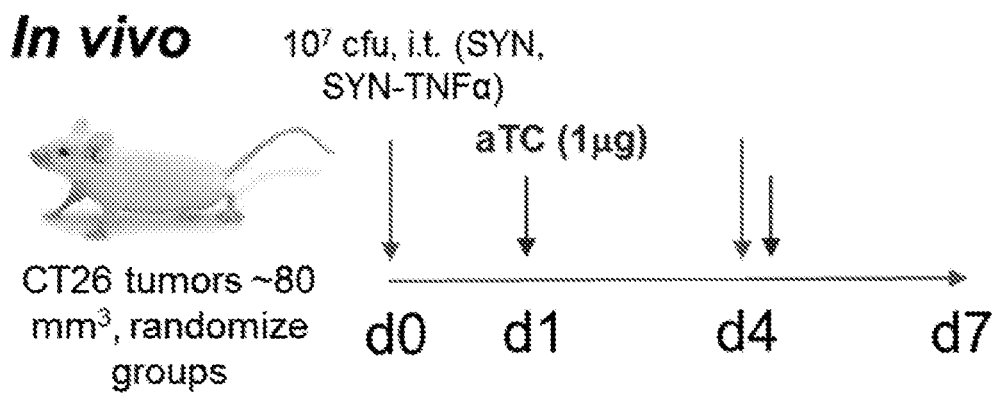
FIG. 52A depicts a schematic showing an outline of an in vivo mouse study, the results of which are shown in FIG. 52B-52D.
Figure 52B:
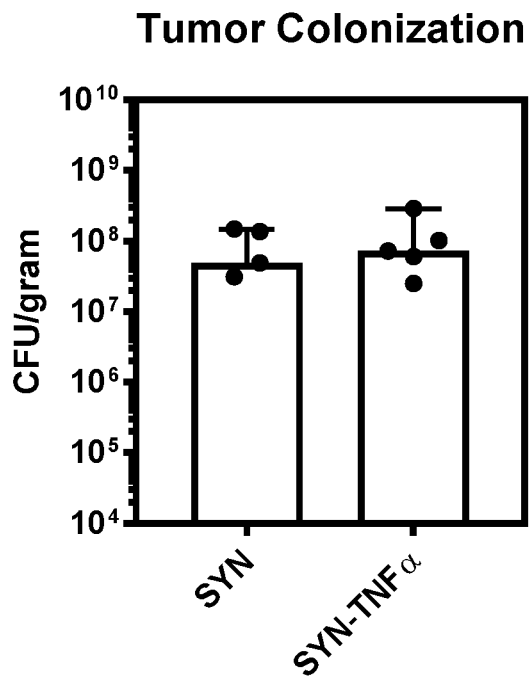
FIG. 52B depicts graphs showing bacterial colonization of tumors as measured by colony forming units (CFU).
Figure 52C:
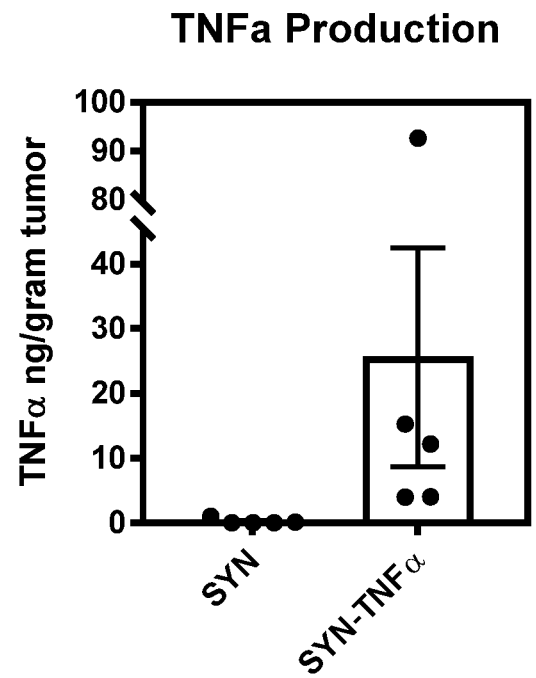
FIG. 52C depicts graphs showing the relative concentration of TNFα in CT26 tumors as measured by ELISA.
Figure 52D:
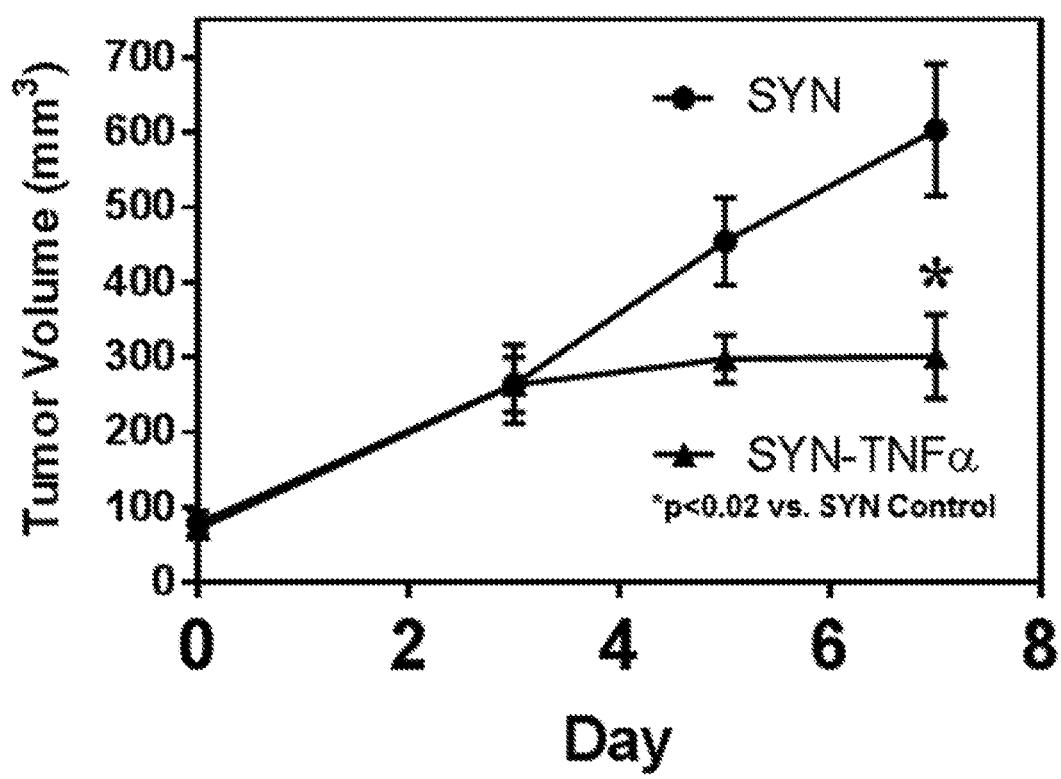
FIG. 52D depicts a line graph showing the average mean tumor volume of mice implanted with CT26 tumors and treated with SYN (DOM Mutant) or SYN-TNFα (comprising PAL::CM p15a TetR Ptet-PhoA-TNFalpha).

Briefly, CT26 cells were implanted ($1\times10^6$ cells/mouse in PBS) SC into the right flank of each animal. Tumor growth was monitored; when the tumors reached ~50-80 mm^3, mice were randomized into groups (N=5 per group) for intratumor dosing as follows: SYN (leaky phenotype DOM mutant, group 1, $1\times10^7$), and SYN-TNFα (TNF-alpha secreter, group 2, $1\times10^7$). On days 0 and 4, mice were injected I.T. with bacteria. On days 1 and 4, both groups were given 1 ug of ATC via IP injection (in two pulses). Tumor size was measured 2× times a week. Tumors were homogenized, tumor homogenates were serially diluted and plated on LB Agar plates containing the appropriate antibiotics in order to measure the colony forming unit concentration. As depicted in FIG. 52B, SYN-TNFα colonized tumors to a similar extent as SYN, reaching up to $1\times10^8$ CFUs/gram tumor. Intrumoral expression of hTNFa was only detected in SYN-TNFα treated CT26 tumors, as measured by hTNFa ELISA (R&D Systems) (FIG. 52C). Results in FIG. 52D show significantly reduced tumor growth for CT26 tumors treated with SYN-TNFα at day 7 post first bacterial dose compared to treatment with SYN (P<0.02). Taken together these results demonstrate the SYN-TNFα is capable of colonizing and persisting in CT26 tumors, where they express detectable levels of hTNFa and result in a significant reduction in tumor growth.

Example 50. Activity of mIFNgamma Secreting Strain SYN3367 In Vivo

To determine the In Vivo dynamics of the IFNgamma expressing strain SYN3367 (comprising PAL::Cm p15a Ptet-87K PhoA-mIFNg; referred herein as SYN-IFNγ) CT26 tumors were treated and compared to SYN1557 (DOM mutant; referred herein as SYN) treated tumors.

To produce bacterial cells for the study, overnight cultures were used to inoculate 500 mL LB medium with antibiotic. The strains were incubated with shaking at 37 C until the the culture reached the end of log phase (OD600=0.8-1.0). To harvest, cells were spun down at 5000 rpm for 20 min, media was aspirated, cells were washed with PBS, resuspended in 15% Glycerol and PBS, aliquoted and frozen at −80 C. Cells were concentration tested by serial plating.

Figure 53A:
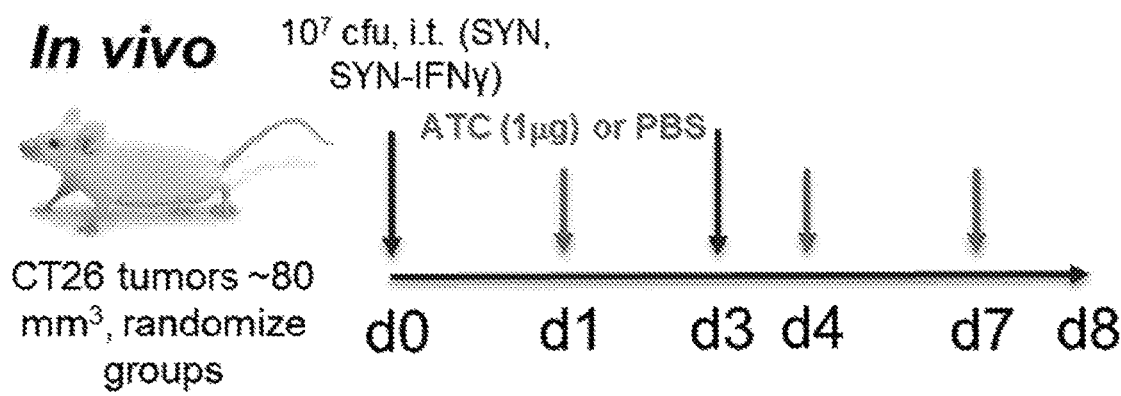
FIG. 53A depicts a schematic showing an outline of an in vivo mouse study, the results of which are shown in FIGS. 53B and 53C.
Figure 53B:
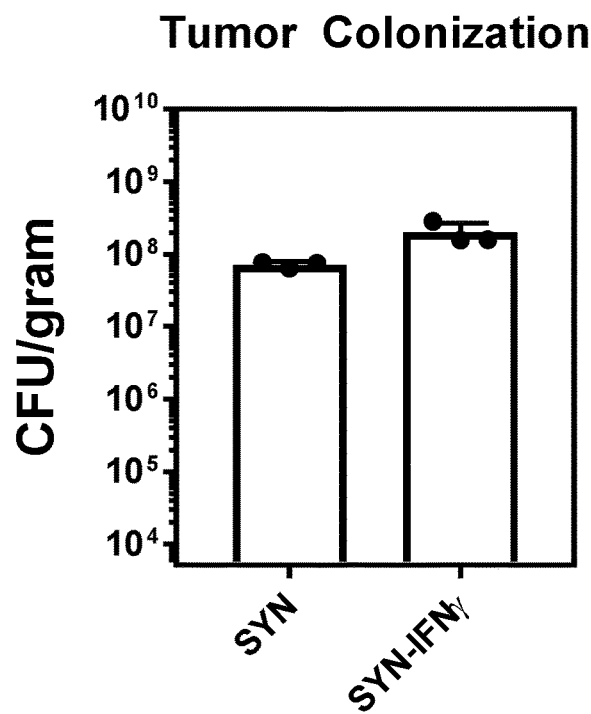
FIG. 53B depicts graphs showing bacterial colonization of tumors as measured by colony forming units (CFU).
Figure 53C:
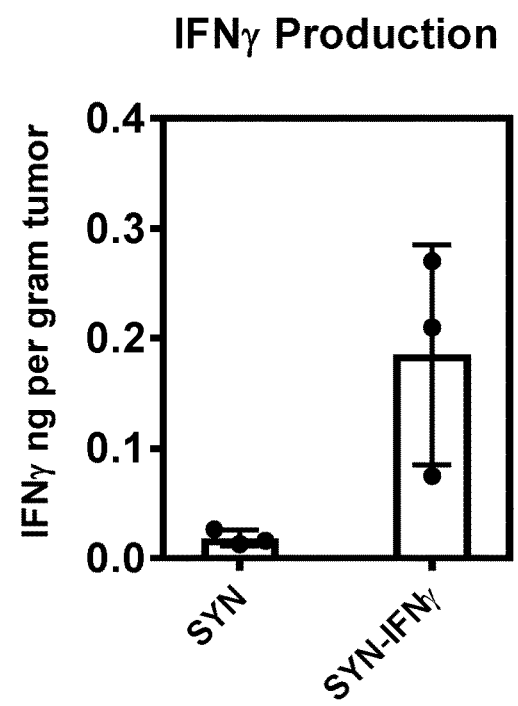
FIG. 53C depicts graphs showing the relative concentration of IFNγ in CT26 tumors as measured by ELISA.
Figure 54A:
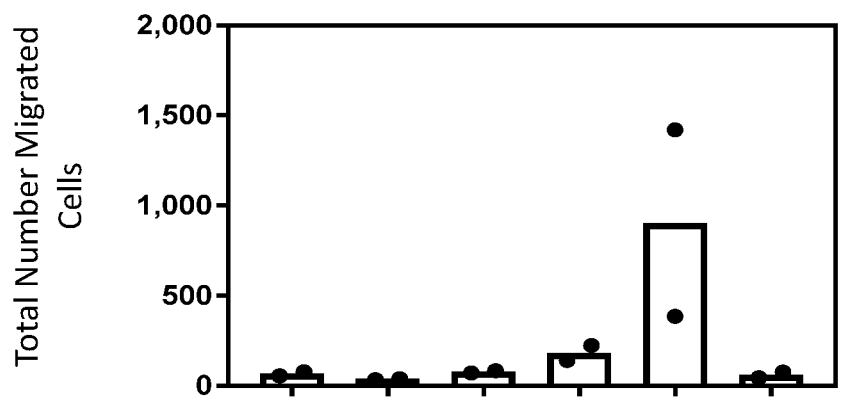
FIG. 54A and FIG. 54B depicts the results of a human T cell transwell assay where the number of migratory cells was measured via flow cytometry following addition of SYN-CXCL10 supernatants diluted at various concentrations in SYN bacterial supernatant. Anti-CXCR3 was added to control wells containing 100% SYN-CXCL10 supernatant to validate specificity of the migration for the CXCL10-CXCR3 pathway.
Figure 54B:
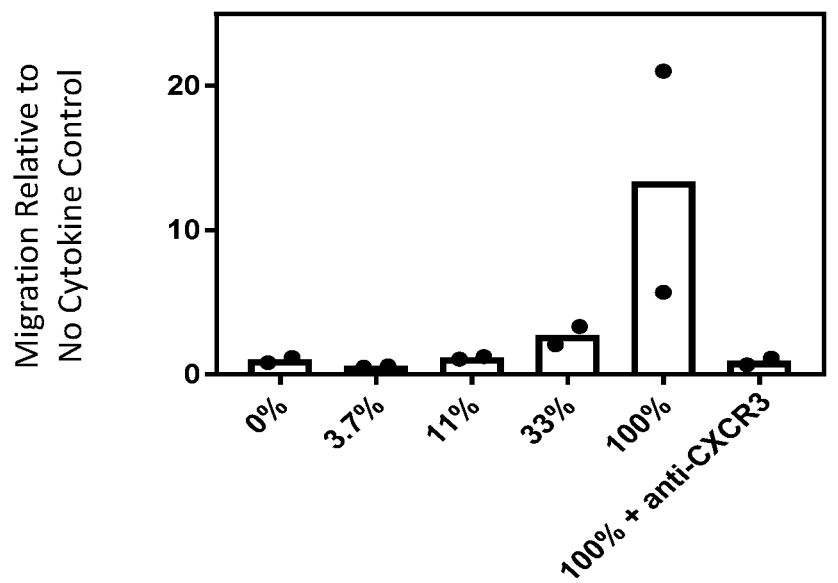

Briefly, CT26 cells were implanted (1×10^6 cells/mouse in PBS) SC into the right flank of each animal. Tumor growth was monitored; until tumors reached ~50-80 mm^3 when mice were randomized into groups (N=6 per group) for intratumor dosing as follows: SYN (leaky phenotype DOM mutant, group 1, 1×10^7) and SYN-IFNγ (IFNgamma secreter, group 2, 1×10^7) On day 0 and day 3 mice were dosed with the appropriate bacterial strain. On days 1, 4 and 7 4, all mice were injected I.P. with 1 ug ATC (in three pulses). On day 8, all mice were sacrificed with 3 mice utilized to measure intratumoral bacterial colonization via CFU plating and 3 mice utilized to analyze intratumoral IFNγ production by ELISA. Tumors were homogenized, tumor homogenates were serially diluted and plated on LB Agar plates containing the appropriate antibiotics in order to measure the colony forming unit concentration. As depicted in Figure XB, SYN-IFNγ colonized tumors to a similar extent as SYN, reaching up to $1 \times 10^8$ CFUs/gram tumor. Intrumoral expression of IFNγ was only detected in SYN-IFNγ treated CT26 tumors, as measured by murine IFNγ ELISA (R&D Systems) (FIG. 53C). Taken together these results demonstrate the SYN-IFNγ is capable of colonizing and persisting in CT26 tumors, where they express detectable levels of IFNγ following induction with ATC.

Example 51. Functional Assay for Secreted CXCL10

To determine whether human CXCL10 secreted from any of the strains described above is functional, a Chemotaxis Assay was performed, essentially as described in Mikucki et al. (Mikucki, et al., Non-redundant Requirement for CXCR3 Signaling during Tumoricidal T Cell Trafficking across Tumor Vascular Checkpoints; Nat Commun. 2015; 6: 7458, the contents of which is herein incorporated by reference in its entirety). In this assay, human CD8+ T cells (8 days post anti-CD3/CD28 expansion) were cell trace violet labeled and transferred into a 24-well transwell plate (5 uM pore) with T cells on top and bacterial supernatants on bottom, in the presence or absence of anti-hCXCR3. Cells were incubated for 3 hrs, and migrated cells recovered from the bottom of wells were counted by flow cytometry.

To prepare the bacterial supernatants, strains (SYN1557 control strain and SYN2942 (comprising PAL::Cm Ptet—87K PhoA (ECOLIN_02255))) were thawed and grown over night, then induced to express hCXCL10 by addition of tetracycline for 3 hours. Supernatants were sterifiltered and then used as noted below. To prepare the T cells, pre-isolated primary human CD8 T cells (AllCells) were counted, harvested and resuspended in T cell media, approximately 8 days post stimulation with anti-CD3/CD28 beads. 24-well trans well plates with space 0.5 ml on bottom and 0.1 ml on top of the wells and 5 uM pore size were used for the assay. To prepare bacterial supernatants for the bottom of the well, supernatants from SYN2942 were diluted in supernatants taken from SYN1557 control bacteria to generate mixtures containing 100%, 33%, 11%, 3.7%, and 0% SYN2942. To prepare the top of the well, 100 uL of T cells were added to the top well (containing approximately 2.5×10 cells). Anti-CXCR3 (mouse IgG1; clone G025H7) was added to the control wells at a final concentration of 1 ug/ml). Plates were placed in 37 C incubator for 3 hours before analysis. For analysis, the contents of each bottom well were transferred to two wells of a 96-well plate. Plates were spun down, two wells were combined, resuspended in PBS, and analyzed on a MACSQuant flow cytometer to quantify the number of migrated cells. Primary human T cells trafficked towards SYN2942 supernatants in a dose-dependent manner which was abrogated by blockade of CXCL10's receptors CXCR3. This data (not shown) would suggest that the hCXCL10 produced by SYN2942 is biologically active and abundant in sufficient concentrations to trigger primary T cell trafficking in vitro.

SEQUENCE LISTING (1253 sequences)

SEQ ID NO: 1 - protein, 447 aa, Artificial Sequence
  Description of Artificial Sequence: Synthetic polypeptide
  Heavy chain humanized
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2 - protein, 218 aa, Artificial Sequence
  Description of Artificial Sequence: Synthetic polypeptide
  Light chain humanized
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 440 aa, Artificial Sequence
  Description of Artificial Sequence: Synthetic polypeptide
  Heavy chain human monoclonal
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4 - protein, 214 aa, Artificial Sequence
  Description of Artificial Sequence: Synthetic polypeptide
  Light chain human monoclonal
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 448 aa, Artificial Sequence
  Description of Artificial Sequence: Synthetic polypeptide
  Ipilimumab, CTLA-4, Heavy chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 118 aa, Artificial Sequence
  Description of Artificial Sequence: Synthetic polypeptide
  Ipilimumab , CTLA-4, Heavy chain variable region
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 7 - protein, 215 aa, Artificial Sequence
  Description of Artificial Sequence: Synthetic polypeptide
  Ipilimumab, CTLA-4, Light chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - protein, 108 aa, Artificial Sequence
  Description of Artificial Sequence: Synthetic polypeptide
  Ipilimumab, CTLA-4, Light chain variable region
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 9 - protein, 411 aa, Artificial Sequence
  Description of Artificial Sequence: Synthetic polypeptide
  Tremelimumab (CP675206), CTLA-4, Heavy chain
PGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10 - protein, 214 aa, Artificial Sequence
  Description of Artificial Sequence: Synthetic polypeptide
  Tremelimumab (CP675206), CTLA-4, Light chain
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 442 aa, Artificial Sequence
  Description of Artificial Sequence: Synthetic polypeptide
  PF-05082566, 4-1BB (CD137, TNFRSF9), Heavy chain
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 12 - protein, 214 aa, Artificial Sequence
  Description of Artificial Sequence: Synthetic polypeptide
  PF-05082566, 4-1BB (CD137, TNFRSF9), Light chain
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 13 - protein, 448 aa, Artificial Sequence
  Description of Artificial Sequence: Synthetic polypeptide
  Urelumab, 4-1BB (CD137, TNFRSF9), Heavy chain
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 14 - protein, 216 aa, Artificial Sequence
  Description of Artificial Sequence: Synthetic polypeptide
  Urelumab, 4-1BB (CD137, TNFRSF9), Light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 117 aa, Artificial Sequence
  Description of Artificial Sequence: Synthetic polypeptide
  Anti-OX40 antibody (Providence Health and Services), CD134 (OX40), Heavy chain
EVQLVESGGGLVQPGGSLRLSCAASGFTFTNYGIHWIRQAPGKGLEWVASISPSGGLTYYRDSVKGRFTISRDDAKNSPYLQMNSLRAEDTAVYYCATGGEGIFDYWGQGTLVTVSS

SEQ ID NO: 16 - protein, 108 aa, Artificial Sequence
  Description of Artificial Sequence: Synthetic polypeptide
  Anti-OX40 antibody (Providence Health and Services), CD134 (OX40), Light chain
DIQMTQSPSSLSASVGDRVTITCRATQSIYNALAWYQQKPGKAPKLLIYNANTLHTGVPSRFSASGSGTDSTLTISSLQPEDFATYYCQQYYDYPLTFGGGTKVEIKR

SEQ ID NO: 17 - protein, 440 aa, Artificial Sequence; identical to SEQ ID NO: 3
  Description of Artificial Sequence: Synthetic polypeptide
  Nivolumab, PD-1, Heavy chain

SEQ ID NO: 18 - protein, 113 aa, Artificial Sequence [sequence omitted]

SEQ ID NO: 19 - protein, 214 aa, Artificial Sequence; identical to SEQ ID NO: 4
  Description of Artificial Sequence: Synthetic polypeptide
  Nivolumab, PD-1, Light chain

SEQ ID NO: 20 - protein, 107 aa, Artificial Sequence [sequence omitted]

SEQ ID NO: 21 - protein, 447 aa, Artificial Sequence
  Description of Artificial Sequence: Synthetic polypeptide
  Pidilizumab, PD-1, Heavy chain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - skipped

SEQ ID NO: 23 - protein, 213 aa, Artificial Sequence
  Description of Artificial Sequence: Synthetic polypeptide
  Pidilizumab, PD-1, Light chain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - skipped

SEQ ID NO: 25 - protein, 447 aa, Artificial Sequence; identical to SEQ ID NO: 1
  Description of Artificial Sequence: Synthetic polypeptide
  Pembrolizumab (MK-3475/SCH900475, lambrolizumab) PD-1, Heavy chain

SEQ ID NO: 26 - protein, 218 aa, Artificial Sequence; identical to SEQ ID NO: 2
  Description of Artificial Sequence: Synthetic polypeptide
  Pembrolizumab (MK-3475/SCH900475, lambrolizumab), PD-1, Light chain  Heavy chain variable region is described in as described in WO2009114335

SEQ ID NO: 27 - protein, 451 aa, Artificial Sequence
  Description of Artificial Sequence: Synthetic polypeptide
  Durvalumab (MEDI4736), PD-L1, Heavy chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 215 aa, Artificial Sequence
  Description of Artificial Sequence: Synthetic polypeptide
  Durvalumab (MEDI4736), PD-L1, Light chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 450 aa, Artificial Sequence
  Description of Artificial Sequence: Synthetic polypeptide
  Lirilumab, KIR, Heavy chain
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 30 - protein, 214 aa, Artificial Sequence
  Description of Artificial Sequence: Synthetic polypeptide
  Lirilumab, KIR, Light chain
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 447 aa, Artificial Sequence
  Description of Artificial Sequence: Synthetic polypeptide
  BMS-986016, LAG3, Heavy chain
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 32 - protein, 214 aa, Artificial Sequence
  Description of Artificial Sequence: Synthetic polypeptide
  BMS986016, LAG3, Light chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 450 aa, Artificial Sequence
  Description of Artificial Sequence: Synthetic polypeptide
  Avelumab  (MSB0010718C), PD-L1, Heavy chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 216 aa, Artificial Sequence
  Description of Artificial Sequence: Synthetic polypeptide
  Avelumab  (MSB0010718C), PD-L1, Light chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 35 - protein, 448 aa, Artificial Sequence
  Description of Artificial Sequence: Synthetic polypeptide
  Atezolizumab (MPDL3280A, RG7446,  RO5541267) PD-L1, Heavy chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 118 aa, Artificial Sequence [sequence omitted]

SEQ ID NO: 37 - protein, 214 aa, Artificial Sequence
  Description of Artificial Sequence: Synthetic polypeptide
  Atezolizumab (MPDL3280A, RG7446,  RO5541267), PD-L1, Light chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 108 aa, Artificial Sequence
  Description of Artificial Sequence: Synthetic polypeptide
  Atezolizumab (MPDL3280A, RG7446, RO5541267), PD-L1, Light chain variable region
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 39 - protein, 449 aa, Artificial Sequence
  Description of Artificial Sequence: Synthetic polypeptide
  Mogamulizumab, CCR4, Heavy chain
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 219 aa, Artificial Sequence
  Description of Artificial Sequence: Synthetic polypeptide
  Mogamulizumab, CCR4, Light chain
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 452 aa, Artificial Sequence
  Description of Artificial Sequence: Synthetic polypeptide
  Varlilumab, CD27, Heavy chain
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSS

SEQ ID NO: 42 - protein, 214 aa, Artificial Sequence
  Description of Artificial Sequence: Synthetic polypeptide
  Varlilumab, CD27, Light chain
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 451 aa, Artificial Sequence
  Description of Artificial Sequence: Synthetic polypeptide
  Ulocuplumab, CXCR4, Heavy chain
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 44 - protein, 214 aa, Artificial Sequence
  Description of Artificial Sequence: Synthetic polypeptide
  Ulocuplumab, CXCR4, Light chain
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 450 aa, Artificial Sequence
  Description of Artificial Sequence: Synthetic polypeptide
  Bavituximab, Phosphatidyl Serine, Heavy chain
EVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 164 aa, Artificial Sequence
  Description of Artificial Sequence: Synthetic polypeptide
  Bavituxumab, Phosphatidyl Serine, Light chain
TSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - DNA, 7584 bp, Artificial Sequence
  Description of Artificial Sequence: Synthetic polynucleotide
  Tet-regulated Tryptophan operon
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaatacgcatggcatggatgaccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcgtgc

SEQ ID NO: 48 - DNA, 623 bp, Artificial Sequence
  Description of Artificial Sequence: Synthetic polynucleotide
  Tet repressor
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacat

SEQ ID NO: 49 - DNA, 124 bp, Artificial Sequence
  Description of Artificial Sequence: Synthetic polynucleotide
  tetR/tetA promoters and RBS and leader region
cattaattcctaatttttgttgacactctatcattgatagagttattttaccactccctatcagtgatagagaaaagtgaactctagaaataattttgtttaactttaagaaggagatatacat

SEQ ID NO: 50 - DNA, 1562 bp, Artificial Sequence
  Description of Artificial Sequence: Synthetic polynucleotide
  trpE
atgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 51 - DNA, 1596 bp, Artificial Sequence
  Description of Artificial Sequence: Synthetic polynucleotide
  trpD
atggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 52 - DNA, 1359 bp, Artificial Sequence
  Description of Artificial Sequence: Synthetic polynucleotide
  trpC
atgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaa

SEQ ID NO: 53 - DNA, 1194 bp, Artificial Sequence
  Description of Artificial Sequence: Synthetic polynucleotide
  trpB
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctga

SEQ ID NO: 54 - DNA, 807 bp, Artificial Sequence
  Description of Artificial Sequence: Synthetic polynucleotide
  trpA
atggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 55 - protein, 520 aa, Artificial Sequence
  Description of Artificial Sequence: Synthetic polypeptide
  TrpE
MQTQKPTLELLTCEGAYRDNPTALFHQLCGDRPATLLLESADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 56 - protein, 531 aa, Artificial Sequence
  Description of Artificial Sequence: Synthetic polypeptide
  TrpD
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPTNTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 57 - protein, 452 aa, Artificial Sequence
  Description of Artificial Sequence: Synthetic polypeptide
  TrpC
MQTVLAKIVADKAIWVETRKEQQPLASFQNEVQPSTRHFYDALQGARTAFILECKKASPSKGVIRDDFDPARIAAIYKHYASAISVLTDEKYFQGSFDFLPIVSQIAPQPILCKDFIIDPYQIYLARYYQADACLLMLSVLDDEQYRQLAAVAHSLEMGVLTEVSNEEELERAIALGAKVVGINNRDLRDLSIDLNRTRELAPKLGHNVTVISESGINTYAQVRELSHFANGFLIGSALMAHDDLNAAVRRVLLGENKVCGLTRGQDAKAAYDAGAIYGGLIFVATSPRCVNVEQAQEVMAAAPLQYVGVFRNHDIADVADKAKVLSLAAVQLHGNEDQLYIDNLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 58 - protein, 397 aa, Artificial Sequence
  Description of Artificial Sequence: Synthetic polypeptide
  TrpB
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPYPTIVREFQRMIGEETKAQILEREGRLPDAVIACVGGGSNAIGMFADFINETDVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHALAHALKMMRENPEKEQLLVVNLSGRGDKDIFTVHDILKARGEI

SEQ ID NO: 59 - protein, 268 aa, Artificial Sequence
  Description of Artificial Sequence: Synthetic polypeptide
  TrpA
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 60 - protein, 350 aa, Artificial Sequence
  Description of Artificial Sequence: Synthetic polypeptide
  AroGfbr: feedback resistant 2-dehydro-3-deoxyphosphoheptonate aldolase from E. coli
MNYQNDDLRIKEIKELLPPVALLEKFPATENAANTVAHARKAIHKILKGNDDRLLVVIGPCSIHDPVAAKEYATRLLTLREELQDELEIVMRVYFEKPRTTVGWKGLINDPHMDNSFQINDGLRIARKLLLDINDSGLPAAGEFLDMITLQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCTDVCQQIAGGEKAIIGVMVESHLVEGNQSLESGEPLAYGKSITDACIGWDDTDALLRQLASAVKARRG

SEQ ID NO: 61 - protein, 520 aa, Artificial Sequence
  Description of Artificial Sequence: Synthetic polypeptide
  TrpEfbr: feedback resistant anthranilate synthase component I from E. coli
MQTQKPTLELLTCEGAYRDNPTALFHQLCGDRPATLLLEFADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 62 - protein, 410 aa, Artificial Sequence
  Description of Artificial Sequence: Synthetic polypeptide
  SerA: 2-oxoglutarate reductase from E. coli Nissle
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 63 - protein, 410 aa, Artificial Sequence
  Description of Artificial Sequence: Synthetic polypeptide
  SerAfbr: feedback resistant 2-oxoglutarate reductase from E. coli Nissle
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIAEARPGVLTALNKIFAEQGVNIAAQYLQTSAQMGYVVIDIEADEDVAEKALQAMKAIPGTIRARLLY

SEQ ID NO: 64 - protein, 471 aa, Artificial Sequence
  Description of Artificial Sequence: Synthetic polypeptide
  TnaA: tryptophanase from E. coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKVMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 65 - protein, 416 aa, Artificial Sequence
  Description of Artificial Sequence: Synthetic polypeptide
  Pseudomonas kynureninase, P83788
MTTRNDCLALDAQDSLAPLRQQFALPEGVIYLDGNSLGARPVAALARAQAVIAEEWGNGLIRSWNSAGWRDLSERLGNRLATLIGARDGEVVVTDTTSINLFKVLSAALRVQATRSPERRVIVTETSNFPTDLYIAEGLADMLQQGYTLRLVDSPEELPQAIDQDTAVVMLTHVNYKTGYMHDMQALTALSHECGALAIWDLAHSAGAVPVDLHQAGADYAIGCTYKYLNGGPGSQAFVWVSPQLCDLVPQPLSGWFGHSRQFAMEPRYEPSNGIARYLCGTQPITSLAMVECGLDVFAQTDMASLRRKSLALTDLFIELVEQRCAAHELTLVTPREHAKRGSHVSFEHPEGYAVIQALIDRGVIGDYREPRIMRFGFTPLYTTFTEVWDAVQILGEILDRKTWAQAQFQVRHSVT

SEQ ID NO: 66 - protein, 465 aa, Artificial Sequence
  Description of Artificial Sequence: Synthetic polypeptide
  Human, Q16719
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 67 - protein, 378 aa, Artificial Sequence
  Description of Artificial Sequence: Synthetic polypeptide
  Shewanella, Q8E973
MLLNVKQDFCLAGPGYLLNHSVGRPLKSTEQALKQAFFAPWQESGREPWGQWLGVIDNFTAALASLFNGQPQDFCPQVNLSSALTKIVMSLDRLTRDLTRNGGAVVLMSEIDFPSMGFALKKALPASCELRFIPKSLDVTDPNVWDAHICDDVDLVFVSHAYSNTGQQAPLAQIISLARERGCLSLVDVAQSAGILPLDLAKLQPDFMIGSSVKWLCSGPGAAYLWVNPAILPECQPQDVGWFSHENPFEFDIHDFRYHPTALRFWGGTPSIAPYAIAAHSIEYFANIGSQVMREHNLQLMEPVVQALDNELVSPQEVDKRSGTIILQFGERQPQILAALAAANISVDTRSLGIRVSPHIYNDEADIARLLGVIKANR

SEQ ID NO: 68 - DNA, 1303 bp, Artificial Sequence
  Description of Artificial Sequence: Synthetic polynucleotide
  kynU (Pseudomonas)
atgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 69 - DNA, 1450 bp, Artificial Sequence
  Description of Artificial Sequence: Synthetic polynucleotide
  kynU(Human)
atggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 70 - DNA, 1189 bp, Artificial Sequence
  Description of Artificial Sequence: Synthetic polynucleotide
  kynU(Shewanella)
atgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 71 - DNA, 1242 bp, Artificial Sequence
  Description of Artificial Sequence: Synthetic polynucleotide
  nupC (polynucleotide)
gtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggttttgccaacgaagggactaacttcgtctttggtagcatgaatgatcaaggcctggcattcttcttcctgaaagtgctgtgcccaatcgtctttatctctgcgctgatcggtattctccagcatattcgcgtattgccggtgattatccgcgcaattggtttcctgctctccaaagtcaacggcatgggcaaactggaatcctttaacgccgtcagctccctgattctgggtcagtctgaaaactttattgcctataaagatatcctcggcaaaatctcccgcaatcgtatgtacaccatggcagcaacggcgatgtccaccgtgtcgatgtccatcgttggtgcatatatgaccatgctggagccgaaatacgtcgttgcggcgctggtactgaacatgttcagcacctttatcgtgctgtcgctgatcaacccttaccgtgttgatgccagtgaagaaaacattcagatgtccaacctgcacgaaggtcagagcttcttcgaaatgctgggtgaatacattctggcaggtttcaaagttgccattatcgttgccgcgatgctgatcggctttatcgccctgatcgctgcactgaacgctctgtttgctaccgtgactggctggtttggctacagcatctccttccagggcatcctgggttacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaa

SEQ ID NO: 72 - DNA, 2259 bp, Artificial Sequence
  Description of Artificial Sequence: Synthetic polynucleotide
  xdhA
atgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttga

SEQ ID NO: 73 - DNA, 879 bp, Artificial Sequence
  Description of Artificial Sequence: Synthetic polynucleotide
  xdhB
atgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatga

SEQ ID NO: 74 - DNA, 480 bp, Artificial Sequence
  Description of Artificial Sequence: Synthetic polynucleotide
  xdhC
atgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 75 - DNA, 1002 bp, Artificial Sequence
  Description of Artificial Sequence: Synthetic polynucleotide
  Add
atgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaa

SEQ ID NO: 76 - DNA, 834 bp, Artificial Sequence
  Description of Artificial Sequence: Synthetic polynucleotide
  xapA
atgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctga

SEQ ID NO: 77 - DNA, 720 bp, Artificial Sequence
  Description of Artificial Sequence: Synthetic polynucleotide
  deoD
atggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 78 - protein, 413 aa, Artificial Sequence
  Description of Artificial Sequence: Synthetic polypeptide
  NupC (polypeptide)
VHGNLTCLIFGANMDRVLHFVLALAVVAILALLVSSDRKKIRIRYVIQLLVIEVLLAWFFLNSDVGLGFVKGFSEMFEKLLGFANEGTNFVFGSMNDQGLAFFFLKVLCPIVFISALIGILQHIRVLPVIIRAIGFLLSKVNGMGKLESFNAVSSLILGQSENFIAYKDILGKISRNRMYTMAATAMSTVSMSIVGAYMTMLEPKYVVAALVLNMFSTFIVLSLINPYRVDASEENIQMSNLHEGQSFFEMLGEYILAGFKVAIIVAAMLIGFIALIAALNALFATVTGWFGYSISFQGILGYIFYPIAWVMGVPSSEALQVGSIMATKLVSNEFVAMMDLQKIASTLSPRAEGIISVFLVSFANFSSIGIIAGAVKGLNEEQGNVVSRFGLKLVYGSTLVSVLSASIAALVL

SEQ ID NO: 79 - protein, 752 aa, Artificial Sequence
  Description of Artificial Sequence: Synthetic polypeptide
  xdhA (polypeptide)
MRVDAIAKVTGRARYTDDYIMAGMCYAKYVRSPIAHGYAVNINDEQARSLPGVLAIFTWEDVPEIPFATAGHAWTLDENKRDTADRALLTRHVRHHGDAVAIVVARDELTAEKAAQLVSIEWQELPVITSPEAALAEDAAPIHNGGNLLKQSTMSTGNVQQTIDAADYQVQGHYQTPVIQHCHMESVTSLAWMEDDSRITIVSSTQIPHIVRRVVGQALDIPWSCVRVIKPFIGGGFGNKQDVLEEPMAAFLTSKLGGIPVKVSLSREECFLATRTRHAFTIDGQMGVNRDGTLKGYSLDVLSNTGAYASHGHSIASAGGNKVAYLYPRCAYAYSSKTCYTNLPSAGAMRGYGAPQVVFAVESMLDDAATALGIDPVEIRLRNAAREGDANPLTGKRIYSAGLPECLEKGRKIFEWEKRRAECQNQQGNLRRGVGVACFSYTSNTWPVGVEIAGARLLMNQDGTINVQSGATEIGQGADTVFSQMVAETVGVPVSDVHVISTQDTDVTPFDPGAFASRQSYVAAPALRSAALLLKEKIIAHAAVMLHQSAMNLTLIKGHIVLIERPEEPLMSLKDLAMDAFYHPERGGQLSAESSIKTTTNPPAFGCTFVDLTVDIALCKVTINRILNVHDSGHILNPLLAEGQVHGGMGMGIGWALFEEMIIDAKSGVVRNPNLLDYKMPTMPDLPQLESAFVEINEPQSAYGHKSLGEPPIIPVAAAIRNAVKMATGVAINTLPLTPKRLYEEFHLAGLI

SEQ ID NO: 80 - protein, 292 aa, Artificial Sequence
  Description of Artificial Sequence: Synthetic polypeptide
  xdhB (polypeptide)
MFDFASYHRATTLADAITLLADNPQAKLLAGGTDVLIQLHHHNDRYRHIVDIHNLAELQGITQAEDGALRIGSATTFTQLIEDPVIQRNLPALCAAAASIAGPQIRNVATYGGNICNGATSADSATPTLIYDAKLELHSPRGVRFVPINGFHTGPGKVSLEHDEILVAFHFPPQPKEHAGSAHFKYAMRDAMDISTIGCAAHCRLDNGNFSELRLAFGVAAPTPIRCQHAEQTAQNAPLNLQTLEAISESVLQDVAPRSSWRASKEFRLHLIQTMTKKVISEAVAAAGGKLQ

SEQ ID NO: 81 - protein, 292 aa, Artificial Sequence; identical to SEQ ID NO: 80
  Description of Artificial Sequence: Synthetic polypeptide
  xdhC (polypeptide)

SEQ ID NO: 82 - protein, 333 aa, Artificial Sequence
  Description of Artificial Sequence: Synthetic polypeptide
  Add (polypeptide)
MIDTTLPLTDIHRHLDGNIRPQTILELGRQYNISLPAQSLETLIPHVQVIANEPDLVSFLTKLDWGVKVLASLDACRRVAFENIEDAARNGLHYVELRFSPGYMAMAHQLPVAGVVEAVIDGVREGCRTFGVQAKLIGIMSRTFGEAACQQELEAFLAHRDQITALDLAGDELGFPGSLFLSHFNRARDAGWHITVHAGEAAGPESIWQAIRELGAERIGHGVKAIEDRALMDFLAEQQIGIESCLTSNIQTSTVADLAAHPLKTFLEHGIRASINTDDPGVQGVDIIHEYTVAAPAAGLSREQIRQAQINGLEMAFLSAEEKRALREKVAAK

SEQ ID NO: 83 - protein, 277 aa, Artificial Sequence
  Description of Artificial Sequence: Synthetic polypeptide
  xapA (polypeptide)
MYQAQFSHNPLYCVDIIKTYKPDFTPRVAFILGSGLGALADQIENAVAISYEKLPGFPVSTVHGHAGELVLGYLQGVPVACMKGRGHFYEGRGMTIMTDAIRTFKLLGCELLFCTNAAGSLRPEVGAGSLVALKDHINTMPGTPMVGLNDERFGERFFSLANAYDAEYRALLQKVAKEEGFPLTEGVFVSYPGPNFETAAEIRMMQIIGGDVVGMSVVPEVISARHCELKVVAVSAITNMAEGLSDVKLSHAQTLAAAELSKQNFINLICGFLRKIA

SEQ ID NO: 84 - protein, 239 aa, Artificial Sequence
  Description of Artificial Sequence: Synthetic polypeptide
  deoD (polypeptide)
MATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 85 - DNA, 60 bp, Artificial Sequence
  Description of Artificial Sequence: Synthetic oligonucleotide
  argA WT
gcaaaaaaacagaataaaaatacaataatttcgaataatcatgcaaagaggtgtaccgtg

SEQ ID NO: 86 - DNA, 60 bp, Artificial Sequence
  Description of Artificial Sequence: Synthetic oligonucleotide
  argA mutant
gcaaaaaaacactttaaaaacttaataatttcctttaatcacttaaagaggtgtaccgtg

SEQ ID NO: 87 - DNA, 76 bp, Artificial Sequence
  Description of Artificial Sequence: Synthetic oligonucleotide
  argI WT
agacttgcaaatgaataatcatccatatagattgaattttaattcattaaggcgttagccacaggagggatctatg

SEQ ID NO: 88 - DNA, 76 bp, Artificial Sequence
  Description of Artificial Sequence: Synthetic oligonucleotide
  argI mutant
agacttgcaaacttatacttatccatatagattttgttttaatttgttaaggcgttagccacaggagggatctatg

SEQ ID NO: 89 - DNA, 160 bp, Artificial Sequence
  Description of Artificial Sequence: Synthetic polynucleotide
  argCBH WT
tcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatg

SEQ ID NO: 90 - DNA, 160 bp, Artificial Sequence
  Description of Artificial Sequence: Synthetic polynucleotide
  argCBH mutant
tcattgttgacacacctctggtcatgatagtatcaaacttcatgggatatttatctttaaaaatacttgaacgttgagcgtaataaaacccaccagccgtaaggtgaatgttttacgtttaacctggcaaccagacataagaaggtgaatagccccgatg

SEQ ID NO: 91 - DNA, 160 bp, Artificial Sequence
  Description of Artificial Sequence: Synthetic polynucleotide
  argE WT
catcggggctattcaccttcttatgtctggttgccaggttaaacgtaaaacattcaccttacggctggtgggttttattacgctcaacgttagtgtatttttattcataaatactgcatgaatattgatactatcatgaccagaggtgtgtcaacaatga

SEQ ID NO: 92 - DNA, 160 bp, Artificial Sequence
  Description of Artificial Sequence: Synthetic polynucleotide
  argE mutant
catcggggctattcaccttcttatgtctggttgccaggttaaacgtaaaacattcaccttacggctggtgggttttattacgctcaacgttcaagtatttttaaagataaatatcccatgaagtttgatactatcatgaccagaggtgtgtcaacaatga

SEQ ID NO: 93 - DNA, 81 bp, Artificial Sequence
  Description of Artificial Sequence: Synthetic oligonucleotide
  carAB WT
agcagatttgcattgatttacgtcatcattgtgaattaatatgcaaataaagtgagtgaatattctctggagggtgttttg

SEQ ID NO: 94 - DNA, 81 bp, Artificial Sequence
  Description of Artificial Sequence: Synthetic oligonucleotide
  carAB mutant
agcagatttgcattgatttacgtcatcattgtcttttaatatcttaataactggagtgacgtttctctggagggtgttttg

SEQ ID NO: 95 - DNA, 88 bp, Artificial Sequence
  Description of Artificial Sequence: Synthetic oligonucleotide
  argD WT
tttctgattgccattcagtgattttttatgcatattttgtgattataatttcatatttatttatgcgtaacagggtgatcatgagatg

SEQ ID NO: 96 - DNA, 88 bp, Artificial Sequence
  Description of Artificial Sequence: Synthetic oligonucleotide
  argD mutant
tttctgattgccattcagtctttttttacttatattttgtctttataatcttatatttatttatgcgtaacagggtgatcatgagatg

SEQ ID NO: 97 - DNA, 219 bp, Artificial Sequence
  Description of Artificial Sequence: Synthetic polynucleotide
  argG WT
ctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgaaagcagaaatccaggctcatcatcagttaattaagcagggtgttattttatg

SEQ ID NO: 98 - DNA, 219 bp, Artificial Sequence
  Description of Artificial Sequence: Synthetic polynucleotide
  argG mutant
ctaatcaccttaatgaatcttcagttcactttcatttgttgaatacttttaccttctcctgctttcccttaagcgcattattttacaaaaaacacactaaactcttcctgtctccgataaaagatgatcttatgaaaacctttttatttcttataaaaatcttgtgaaagcagaaatccaggctcatcatcagttaattaagcagggtgttattttatg

SEQ ID NO: 99 - DNA, 233 bp, Artificial Sequence
  Description of Artificial Sequence: Synthetic polynucleotide
  argG mutant
cctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcattgacggctagctcagtcctaggtacagtgctagcacccgtttttttgggctagaaataattttgtttaactttaagaaggagatatacataccc

SEQ ID NO: 100 - DNA, 1053 bp, Artificial Sequence
  Description of Artificial Sequence: Synthetic polynucleotide
  Wild-type argG
gtgatccacgccacattttgtcaacgtttattgctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgaaagcagaaatccaggctcatcatcagttaattaagcagggtgttattttatgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgatgctggaagctaaccgcatcggc

SEQ ID NO: 101 - DNA, 734 bp, Artificial Sequence
  Description of Artificial Sequence: Synthetic polynucleotide
  Constitutive argG
ttgacggctagctcagtcctaggtacagtgctagcacccgtttttttgggctagaaataattttgtttaactttaagaaggagatatacatacccatgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagc

SEQ ID NO: 102 - DNA, 1332 bp, Artificial Sequence
  Description of Artificial Sequence: Synthetic polynucleotide
  Nucleotide sequence of exemplary argAfbr sequence
atggtaaaggaacgtaaaaccgagttggtcgagggattccgccattcggttccctgtatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggctaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 103 - protein, 443 aa, Artificial Sequence
  Description of Artificial Sequence: Synthetic polypeptide
  Polypeptide sequence of exemplary argAfbr sequence
MVKERKTELVEGFRHSVPCINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 104 - protein, 26 aa, Artificial Sequence
  Description of Artificial Sequence: Synthetic peptide
  melittin
GIGAVLKVLTTGLPALISWIKRKKQQ

SEQ ID NO: 105 - protein, 37 aa, Artificial Sequence
  Description of Artificial Sequence: Synthetic polypeptide
  LL-37
LLGDFFRKSKEKIGKEFKRIVQRIKDFLRNLVPRTES

SEQ ID NO: 106 - protein, 35 aa, Artificial Sequence
  Description of Artificial Sequence: Synthetic polypeptide
  cecropin B
KWKVFKKIEKMGRNIRNGIVKAGPAIAVLGEAKAL

SEQ ID NO: 107 - protein, 24 aa, Artificial Sequence
  Description of Artificial Sequence: Synthetic peptide
  Magainin 2
GIGKFLHSAKKFGKAFVGEEIMNS

SEQ ID NO: 108 - protein, 10 aa, Artificial Sequence
  Description of Artificial Sequence: Synthetic peptide
  EZH2
FINDEIFVEL

SEQ ID NO: 109 - protein, 9 aa, Artificial Sequence
  Description of Artificial Sequence: Synthetic peptide
  EZH2
KYDCFLHPF

SEQ ID NO: 110 - protein, 9 aa, Artificial Sequence
  Description of Artificial Sequence: Synthetic peptide
  EZH2
KYVGIEREM

SEQ ID NO: 111 - protein, 9 aa, Artificial Sequence
  Description of Artificial Sequence: Synthetic peptide
  glypican-3
EYILSLEEL

SEQ ID NO: 112 - DNA, 18 bp, Artificial Sequence
  Description of Artificial Sequence: Synthetic oligonucleotide
  consensus sequence
ttgttgayryrtcaacwa

SEQ ID NO: 113 - DNA, 15 bp, Artificial Sequence
  Description of Artificial Sequence: Synthetic oligonucleotide
  consensus sequence
  modified_base (8)..(8): a, c, g or t
ttataatnattataa

SEQ ID NO: 114 - DNA, 22 bp, Artificial Sequence
  Description of Artificial Sequence: Synthetic oligonucleotide
  LacO
ggaattgtgagcgctcacaatt

SEQ ID NO: 115 - DNA, 24 bp, Artificial Sequence
  Description of Artificial Sequence: Synthetic oligonucleotide
  UP element helps recruit RNA polymerase
ggaaaatttttttaaaaaaaaaac

SEQ ID NO: 116 - DNA, 25 bp, Artificial Sequence
  Description of Artificial Sequence: Synthetic oligonucleotide
  RBS
ttatataaaagtgggaggtgcccga

SEQ ID NO: 117 - protein, 9 aa, Artificial Sequence
  Description of Artificial Sequence: Synthetic peptide
  MAGE-A1
KVLEYVIKV

SEQ ID NO: 118 - protein, 10 aa, Artificial Sequence
  Description of Artificial Sequence: Synthetic peptide
  Melan-A / MART-1
  MISC_FEATURE (1)..(1): May or may not be present
EAAGIGILTV

SEQ ID NO: 119 - protein, 9 aa, Artificial Sequence
  Description of Artificial Sequence: Synthetic peptide
  Melan-A / MART-1
ILTVILGVL

SEQ ID NO: 120 - protein, 11 aa, Artificial Sequence
  Description of Artificial Sequence: Synthetic peptide
  Melan-A / MART-1
  MISC_FEATURE (11)..(11): May or may not be present
AEEAAGIGILT

SEQ ID NO: 121 - protein, 11 aa, Artificial Sequence
  Description of Artificial Sequence: Synthetic peptide
  Melan-A / MART-1
RNGYRALMDKS

SEQ ID NO: 122 - protein, 12 aa, Artificial Sequence
  Description of Artificial Sequence: Synthetic peptide
  Melan-A / MART-1
EEAAGIGILTVI

SEQ ID NO: 123 - DNA, 46 bp, Artificial Sequence
  Description of Artificial Sequence: Synthetic oligonucleotide
  SR34
cgcacactggcgtcggctctggcaggatgtttcgtaattagatagc

SEQ ID NO: 124 - protein, 453 aa, Artificial Sequence
  Description of Artificial Sequence: Synthetic polypeptide
  Bevacizumab (Avastin) anti-VEGF, Heavy Chain
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 214 aa, Artificial Sequence
  Description of Artificial Sequence: Synthetic polypeptide
  Bevacizumab (Avastin) anti-VEGF, Light Chain
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 9 aa, Artificial Sequence
  Description of Artificial Sequence: Synthetic peptide
  D-peptide A
RLYLRIGRR

SEQ ID NO: 127 - protein, 9 aa, Artificial Sequence
  Description of Artificial Sequence: Synthetic peptide
  D-peptide B
RLRLRIGRR

SEQ ID NO: 128 - protein, 9 aa, Artificial Sequence
  Description of Artificial Sequence: Synthetic peptide
  D-peptide C
ALYLAIRRR

SEQ ID NO: 129 - protein, 9 aa, Artificial Sequence
  Description of Artificial Sequence: Synthetic peptide
  D-peptide D
RLLLRIGRR

SEQ ID NO: 130 - protein, 15 aa, Artificial Sequence
  Description of Artificial Sequence: Synthetic peptide
  D-K6L9
LKLLKKLLKKLLKLL

SEQ ID NO: 131 - protein, 26 aa, Artificial Sequence
  Description of Artificial Sequence: Synthetic peptide
  NRC-03
GRRKRKWLRRIGKGVKIIGGAALDHL

SEQ ID NO: 132 - protein, 25 aa, Artificial Sequence
  Description of Artificial Sequence: Synthetic peptide
  NRC-07
RWGKWFKKATHVGKHVGKAALTAYL

SEQ ID NO: 133 - protein, 18 aa, Artificial Sequence
  Description of Artificial Sequence: Synthetic peptide
  Gomesin
ZCRRLCYKQRCVTYCRGR

SEQ ID NO: 134 - protein, 20 aa, Artificial Sequence
  Description of Artificial Sequence: Synthetic peptide
  Hepcidin TH2-3
QSHLSLCRWCCNCCRSNKGC

SEQ ID NO: 135 - protein, 33 aa, Artificial Sequence
  Description of Artificial Sequence: Synthetic polypeptide
  Dermaseptin B2
GLWSKIKEVGKEAAKAAAKAAGKAALGAVSEAV

SEQ ID NO: 136 - protein, 13 aa, Artificial Sequence
  Description of Artificial Sequence: Synthetic peptide
  PTP7
FLGALFKALSKLL

SEQ ID NO: 137 - protein, 42 aa, Artificial Sequence
  Description of Artificial Sequence: Synthetic polypeptide
  MGA2
GIGKFLHSAKKFGKAFVGEIMNSGGKKWKMRRNQFWVKVQRG

SEQ ID NO: 138 - protein, 30 aa, Artificial Sequence
  Description of Artificial Sequence: Synthetic polypeptide
  HNP-1
ACYCRIPACIAGERRYGTCIYQGRLWAFCC

SEQ ID NO: 139 - protein, 17 aa, Artificial Sequence
  Description of Artificial Sequence: Synthetic peptide
  Tachyplesin
KWCFRVCYRGICYRRCR

SEQ ID NO: 140 - protein, 15 aa, Artificial Sequence
  Description of Artificial Sequence: Synthetic peptide
  Temporin-1CEa
FVDLKKIANIINSIF

SEQ ID NO: 141 - protein, 27 aa, Artificial Sequence
  Description of Artificial Sequence: Synthetic peptide
  NK-2
KILRGVCKKIMRTFLRRISKDILTGKK

SEQ ID NO: 142 - protein, 6 aa, Artificial Sequence
  Description of Artificial Sequence: Synthetic peptide
  Bovine lactoferricin B6 (Lbcin B6)
RRWQWR

SEQ ID NO: 143 - protein, 34 aa, Artificial Sequence
  Description of Artificial Sequence: Synthetic polypeptide
  Cecropin CB1
KWKVFKKIEKMGRNIRNGIVKAGPKWKVFKKIEK

SEQ ID NO: 144 - protein, 26 aa, Artificial Sequence
  Description of Artificial Sequence: Synthetic peptide
  Melittin
GIGAVLKVLTTGLPALISWIKRKRQQ

SEQ ID NO: 145 - protein, 17 aa, Artificial Sequence
  Description of Artificial Sequence: Synthetic peptide
  Tachyplesin
KWCFRVCYRGICYRRCR

SEQ ID NO: 146 - protein, 37 aa, Artificial Sequence; identical to SEQ ID NO: 105
  Description of Artificial Sequence: Synthetic polypeptide
  LL-37

SEQ ID NO: 147 - protein, 35 aa, Artificial Sequence; identical to SEQ ID NO: 106
  Description of Artificial Sequence: Synthetic polypeptide
  Cecropin B

SEQ ID NO: 148 - protein, 23 aa, Artificial Sequence
  Description of Artificial Sequence: Synthetic peptide
  Magainin 2
GIGKFLHSAKKFGKAFVGEIMNS

SEQ ID NO: 149 - protein, 21 aa, Artificial Sequence
  Description of Artificial Sequence: Synthetic peptide
  Buforin IIb
RAGLQFPVGRLLRRLLRRLLR

SEQ ID NO: 150 - protein, 13 aa, Artificial Sequence
  Description of Artificial Sequence: Synthetic peptide
  Alloferon-1
HGVSGHGQHGVHG

SEQ ID NO: 151 - protein, 12 aa, Artificial Sequence
  Description of Artificial Sequence: Synthetic peptide
  Alloferon-2
GVSGHGQHGVHG

SEQ ID NO: 152 - protein, 253 aa, Artificial Sequence
  Description of Artificial Sequence: Synthetic polypeptide
  interleukin-12 subunit alpha precursor (homo sapiens)
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 153 - protein, 328 aa, Artificial Sequence
  Description of Artificial Sequence: Synthetic polypeptide
  interleukin-12 subunit beta precursor (homo sapiens)
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 154 - protein, 162 aa, Artificial Sequence
  Description of Artificial Sequence: Synthetic polypeptide
  interleukin-15 isoform1 preproprotein (homo sapiens)
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 155 - protein, 135 aa, Artificial Sequence
  Description of Artificial Sequence: Synthetic polypeptide
  interleukin-15 isoform 2 preproprotein (homo sapiens)
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 156 - protein, 153 aa, Artificial Sequence
  Description of Artificial Sequence: Synthetic polypeptide
  interleukin-2 precursor (homo sapiens)
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 157 - protein, 162 aa, Artificial Sequence
  Description of Artificial Sequence: Synthetic polypeptide
  interleukin-21 isoform 1 precursor (homo sapiens)
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 158 - protein, 153 aa, Artificial Sequence
  Description of Artificial Sequence: Synthetic polypeptide
  interleukin-21 isoform 2 precursor (homo sapiens)
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKVSTLSFI

SEQ ID NO: 159 - protein, 144 aa, Artificial Sequence
  Description of Artificial Sequence: Synthetic polypeptide
  granulocyte-macrophage colony-stimulating factor precursor (homo sapiens)
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 160 - protein, 10 aa, Artificial Sequence
  Description of Artificial Sequence: Synthetic peptide
  alpha-actinin-4
FIASNGVKLV

SEQ ID NO: 161 - protein, 16 aa, Artificial Sequence
  Description of Artificial Sequence: Synthetic peptide
  ARTC1
YSVYFNLPADTIYTNH

SEQ ID NO: 162 - protein, 9 aa, Artificial Sequence
  Description of Artificial Sequence: Synthetic peptide
  BCR-ABL fusion protein (b3a2)
SSKALQRPV

SEQ ID NO: 163 - protein, 9 aa, Artificial Sequence
  Description of Artificial Sequence: Synthetic peptide
  BCR-ABL fusion protein (b3a2)
GFKQSSKAL

SEQ ID NO: 164 - protein, 17 aa, Artificial Sequence
  Description of Artificial Sequence: Synthetic peptide
  BCR-ABL fusion protein (b3a2)
ATGFKQSSKALQRPVAS

SEQ ID NO: 165 - protein, 29 aa, Artificial Sequence
  Description of Artificial Sequence: Synthetic peptide
  B-RAF
EDLTVKIGDFGLATEKSRWSGSHQFEQLS

SEQ ID NO: 166 - protein, 10 aa, Artificial Sequence
  Description of Artificial Sequence: Synthetic peptide
  CASP-5
FLIIWQNTMG

SEQ ID NO: 167 - protein, 9 aa, Artificial Sequence
  Description of Artificial Sequence: Synthetic peptide
  CASP-8
FPSDSWCYF

SEQ ID NO: 168 - protein, 9 aa, Artificial Sequence
  Description of Artificial Sequence: Synthetic peptide
  beta-catenin
SYLDSGIHF

SEQ ID NO: 169 - protein, 13 aa, Artificial Sequence
  Description of Artificial Sequence: Synthetic peptide
  Cdc27
FSWAMDLDPKGAE

SEQ ID NO: 170 - protein, 10 aa, Artificial Sequence
  Description of Artificial Sequence: Synthetic peptide
  CDK4
ACDPHSGHFV

SEQ ID NO: 171 - protein, 9 aa, Artificial Sequence
  Description of Artificial Sequence: Synthetic peptide
  CDK12
CILGKLFTK

SEQ ID NO: 172 - protein, 10 aa, Artificial Sequence
  Description of Artificial Sequence: Synthetic peptide
  CDKN2A
AVCPWTWLRG

SEQ ID NO: 173 - protein, 9 aa, Artificial Sequence
  Description of Artificial Sequence: Synthetic peptide
  CLPP
ILDKVLVHL

SEQ ID NO: 174 - protein, 15 aa, Artificial Sequence
  Description of Artificial Sequence: Synthetic peptide
  COA-1
TLYQDDTLTLQAAGE

SEQ ID NO: 175 - protein, 9 aa, Artificial Sequence
  Description of Artificial Sequence: Synthetic peptide
  CSNK1A1
GLFGDIYLA

SEQ ID NO: 176 - protein, 16 aa, Artificial Sequence
  Description of Artificial Sequence: Synthetic peptide
  dek-can fusion protein
TMKQICKKEIRRLHQY

SEQ ID NO: 177 - protein, 10 aa, Artificial Sequence
  Description of Artificial Sequence: Synthetic peptide
  EFTUD2
KILDAVVAQK

SEQ ID NO: 178 - protein, 9 aa, Artificial Sequence
  Description of Artificial Sequence: Synthetic peptide
  Elongation factor 2
ETVSEQSNV

SEQ ID NO: 179 - protein, 10 aa, Artificial Sequence
  Description of Artificial Sequence: Synthetic peptide
  ETV6-AML1 fusion protein
RIAECILGMI

SEQ ID NO: 180 - protein, 15 aa, Artificial Sequence
  Description of Artificial Sequence: Synthetic peptide
  ETV6-AML1 fusion protein
IGRIAECILGMNPSR

SEQ ID NO: 181 - protein, 10 aa, Artificial Sequence
  Description of Artificial Sequence: Synthetic peptide
  FLT3-ITD
YVDFREYEYY

SEQ ID NO: 182 - protein, 9 aa, Artificial Sequence
  Description of Artificial Sequence: Synthetic peptide
  FNDC3B
VVMSWAPPV

SEQ ID NO: 183 - protein, 14 aa, Artificial Sequence
  Description of Artificial Sequence: Synthetic peptide
  FN1
MIFEKHGFRRTTPP

SEQ ID NO: 184 - protein, 10 aa, Artificial Sequence
  Description of Artificial Sequence: Synthetic peptide
  GAS7
SLADEAEVYL

SEQ ID NO: 185 - protein, 10 aa, Artificial Sequence
  Description of Artificial Sequence: Synthetic peptide
  GPNMB
TLDWLLQTPK

SEQ ID NO: 186 - protein, 9 aa, Artificial Sequence
  Description of Artificial Sequence: Synthetic peptide
  HAUS3
ILNAMIAKI

SEQ ID NO: 187 - protein, 8 aa, Artificial Sequence
  Description of Artificial Sequence: Synthetic peptide
  HSDL1
CYMEAVAL

SEQ ID NO: 188 - protein, 9 aa, Artificial Sequence
  Description of Artificial Sequence: Synthetic peptide
  LDLR-fucosyltransferaseAS
WRRAPAPGA

SEQ ID NO: 189 - protein, 9 aa, Artificial Sequence
  Description of Artificial Sequence: Synthetic peptide
  fusion protein
PVTWRRAPA

SEQ ID NO: 190-191 - skipped (2 entries)

SEQ ID NO: 192 - protein, 10 aa, Artificial Sequence
  Description of Artificial Sequence: Synthetic peptide
  hsp70-2
SLFEGIDIYT

SEQ ID NO: 193 - protein, 9 aa, Artificial Sequence
  Description of Artificial Sequence: Synthetic peptide
  hsp70-2
AEPINIQTW

SEQ ID NO: 194 - protein, 11 aa, Artificial Sequence
  Description of Artificial Sequence: Synthetic peptide
  MART2
FLEGNEVGKTY

SEQ ID NO: 195 - protein, 9 aa, Artificial Sequence
  Description of Artificial Sequence: Synthetic peptide
  MATN
KTLTSVFQK

SEQ ID NO: 196 - protein, 9 aa, Artificial Sequence
  Description of Artificial Sequence: Synthetic peptide
  ME1
FLDEFMEGV

SEQ ID NO: 197 - protein, 9 aa, Artificial Sequence
  Description of Artificial Sequence: Synthetic peptide
  MUM-1f
EEKLIVVLF

SEQ ID NO: 198 - protein, 11 aa, Artificial Sequence
  Description of Artificial Sequence: Synthetic peptide
  MUM-2
SELFRSGLDSY

SEQ ID NO: 199 - protein, 9 aa, Artificial Sequence
  Description of Artificial Sequence: Synthetic peptide
  MUM-2
FRSGLDSYV

SEQ ID NO: 200 - protein, 9 aa, Artificial Sequence
  Description of Artificial Sequence: Synthetic peptide
  MUM-3
EAFIQPITR

SEQ ID NO: 201 - protein, 12 aa, Artificial Sequence
  Description of Artificial Sequence: Synthetic peptide
  neo-PAP
RVIKNSIRLTLE

SEQ ID NO: 202 - protein, 9 aa, Artificial Sequence
  Description of Artificial Sequence: Synthetic peptide
  Myosin class I
KINKNPKYK

SEQ ID NO: 203 - protein, 8 aa, Artificial Sequence
  Description of Artificial Sequence: Synthetic peptide
  NFYC
QQITKTEV

SEQ ID NO: 204 - protein, 11 aa, Artificial Sequence
  Description of Artificial Sequence: Synthetic peptide
  OGT
SLYKFSPFPLG

SEQ ID NO: 205 - protein, 9 aa, Artificial Sequence
  Description of Artificial Sequence: Synthetic peptide
  OS-9
KELEGILLL

SEQ ID NO: 206 - protein, 9 aa, Artificial Sequence
  Description of Artificial Sequence: Synthetic peptide
  p53
VVPCEPPEV

SEQ ID NO: 207 - protein, 25 aa, Artificial Sequence
  Description of Artificial Sequence: Synthetic peptide
  pml-RARalpha fusion protein
NSNHVASGAGEAAIETQSSSSEEIV

SEQ ID NO: 208 - protein, 9 aa, Artificial Sequence
  Description of Artificial Sequence: Synthetic peptide
  PPP1R3B
YTDFHCQYV

SEQ ID NO: 209 - protein, 10 aa, Artificial Sequence
  Description of Artificial Sequence: Synthetic peptide
  PRDX5
LLLDDLLVSI

SEQ ID NO: 210 - protein, 16 aa, Artificial Sequence
  Description of Artificial Sequence: Synthetic peptide
  PTPRK
PYYFAAELPPRNLPEP

SEQ ID NO: 211 - protein, 9 aa, Artificial Sequence
  Description of Artificial Sequence: Synthetic peptide
  K-ras
VVVGAVGVG

SEQ ID NO: 212 - protein, 10 aa, Artificial Sequence
  Description of Artificial Sequence: Synthetic peptide
  N-ras
ILDTAGREEY

SEQ ID NO: 213 - protein, 9 aa, Artificial Sequence
  Description of Artificial Sequence: Synthetic peptide
  RBAF600
RPHVPESAF

SEQ ID NO: 214 - protein, 9 aa, Artificial Sequence
  Description of Artificial Sequence: Synthetic peptide
  SIRT2
KIFSEVTLK

SEQ ID NO: 215 - protein, 9 aa, Artificial Sequence
  Description of Artificial Sequence: Synthetic peptide
  SNRPD1
SHETVIIEL

SEQ ID NO: 216 - protein, 10 aa, Artificial Sequence
  Description of Artificial Sequence: Synthetic peptide
  SYT-SSX1 or -SSX2 fusion protein
QRPYGYDQIM

SEQ ID NO: 217 - protein, 10 aa, Artificial Sequence
  Description of Artificial Sequence: Synthetic peptide
  TGF-betaRII
RLSSCVPVAG

SEQ ID NO: 218 - protein, 15 aa, Artificial Sequence
  Description of Artificial Sequence: Synthetic peptide
  Triosephosphate isomerase
GELIGILNAAKVPAD

SEQ ID NO: 219 - protein, 9 aa, Artificial Sequence
  Description of Artificial Sequence: Synthetic peptide
  Cyclin-A1
FLDRFLSCM

SEQ ID NO: 220 - protein, 11 aa, Artificial Sequence
  Description of Artificial Sequence: Synthetic peptide
  Cyclin-A1
SLIAAAAFCLA

SEQ ID NO: 221 - protein, 8 aa, Artificial Sequence
  Description of Artificial Sequence: Synthetic peptide
  GAGE-1,2,8
YRPRPRRY

SEQ ID NO: 222 - protein, 9 aa, Artificial Sequence
  Description of Artificial Sequence: Synthetic peptide
  GAGE-3,4,5,6,7
YYWPRPRRY

SEQ ID NO: 223 - protein, 10 aa, Artificial Sequence
  Description of Artificial Sequence: Synthetic peptide
  GnTVf
  MISC_FEATURE (10)..(10): May or may not be present
VLPDVFIRCV

SEQ ID NO: 224 - protein, 9 aa, Artificial Sequence
  Description of Artificial Sequence: Synthetic peptide
  HERV-K-MEL
MLAVISCAV

SEQ ID NO: 225 - protein, 9 aa, Artificial Sequence
  Description of Artificial Sequence: Synthetic peptide
  KK-LC-1
RQKRILVNL

SEQ ID NO: 226 - protein, 9 aa, Artificial Sequence
  Description of Artificial Sequence: Synthetic peptide
  KM-HN-1
NYNNFYRFL

SEQ ID NO: 227 - protein, 10 aa, Artificial Sequence
  Description of Artificial Sequence: Synthetic peptide
  KM-HN-1
EYSKECLKEF

SEQ ID NO: 228 - protein, 9 aa, Artificial Sequence
  Description of Artificial Sequence: Synthetic peptide
  KM-HN-1
EYLSLSDKI

SEQ ID NO: 229 - protein, 11 aa, Artificial Sequence
  Description of Artificial Sequence: Synthetic peptide
  LAGE-1
MLMAQEALAFL

SEQ ID NO: 230 - protein, 9 aa, Artificial Sequence
  Description of Artificial Sequence: Synthetic peptide
  LAGE-1
SLLMWITQC

SEQ ID NO: 231 - protein, 10 aa, Artificial Sequence
  Description of Artificial Sequence: Synthetic peptide
  LAGE-1
LAAQERRVPR

SEQ ID NO: 232 - protein, 9 aa, Artificial Sequence
  Description of Artificial Sequence: Synthetic peptide
  LAGE-1
ELVRRILSR

SEQ ID NO: 233 - protein, 9 aa, Artificial Sequence
  Description of Artificial Sequence: Synthetic peptide
  LAGE-1
APRGVRMAV

SEQ ID NO: 234 - protein, 14 aa, Artificial Sequence
  Description of Artificial Sequence: Synthetic peptide
  LAGE-1
SLLMWITQCFLPVF

SEQ ID NO: 235 - protein, 20 aa, Artificial Sequence
  Description of Artificial Sequence: Synthetic peptide
  LAGE-1
QGAMLAAQERRVPRAAEVPR

SEQ ID NO: 236 - protein, 18 aa, Artificial Sequence
  Description of Artificial Sequence: Synthetic peptide
  LAGE-1
AADHRQLQLSISSCLQQL

SEQ ID NO: 237 - protein, 22 aa, Artificial Sequence
  Description of Artificial Sequence: Synthetic peptide
  LAGE-1
CLSRRPWKRSWSAGSCPGMPHL

SEQ ID NO: 238 - protein, 13 aa, Artificial Sequence
  Description of Artificial Sequence: Synthetic peptide
  LAGE-1
ILSRDAAPLPRPG

SEQ ID NO: 239 - protein, 14 aa, Artificial Sequence
  Description of Artificial Sequence: Synthetic peptide
  LAGE-1
AGATGGRGPRGAGA

SEQ ID NO: 240 - protein, 10 aa, Artificial Sequence
  Description of Artificial Sequence: Synthetic peptide
  LY6K
RYCNLEGPPI

SEQ ID NO: 241 - protein, 24 aa, Artificial Sequence
  Description of Artificial Sequence: Synthetic peptide
  LY6K
KWTEPYCVIAAVKIFPRFFMVAKQ

SEQ ID NO: 242 - protein, 20 aa, Artificial Sequence
  Description of Artificial Sequence: Synthetic peptide
  LY6K
KCCKIRYCNLEGPPINSSVF

SEQ ID NO: 243 - protein, 9 aa, Artificial Sequence
  Description of Artificial Sequence: Synthetic peptide
  MAGE-A1
EADPTGHSY

SEQ ID NO: 244 - protein, 9 aa, Artificial Sequence
  Description of Artificial Sequence: Synthetic peptide
  MAGE-A1
SLFRAVITK

SEQ ID NO: 245 - protein, 10 aa, Artificial Sequence
  Description of Artificial Sequence: Synthetic peptide
  MAGE-A1
EVYDGREHSA

SEQ ID NO: 246 - protein, 9 aa, Artificial Sequence
  Description of Artificial Sequence: Synthetic peptide
  MAGE-A1
RVRFFFPSL

SEQ ID NO: 247 - protein, 9 aa, Artificial Sequence
  Description of Artificial Sequence: Synthetic peptide
  MAGE-A1
EADPTGHSY

SEQ ID NO: 248 - protein, 10 aa, Artificial Sequence
  Description of Artificial Sequence: Synthetic peptide
  MAGE-A1
REPVTKAEML

SEQ ID NO: 249 - protein, 10 aa, Artificial Sequence
  Description of Artificial Sequence: Synthetic peptide
  MAGE-A1
KEADPTGHSY

SEQ ID NO: 250 - protein, 9 aa, Artificial Sequence
  Description of Artificial Sequence: Synthetic peptide
  MAGE-A1
DPARYEFLW

SEQ ID NO: 251 - protein, 11 aa, Artificial Sequence
  Description of Artificial Sequence: Synthetic peptide
  MAGE-A1
ITKKVADLVGF

SEQ ID NO: 252 - protein, 9 aa, Artificial Sequence
  Description of Artificial Sequence: Synthetic peptide
  MAGE-A1
SAFPTTINF

SEQ ID NO: 253 - protein, 9 aa, Artificial Sequence
  Description of Artificial Sequence: Synthetic peptide
  MAGE-A1
SAYGEPRKL

SEQ ID NO: 254 - protein, 9 aa, Artificial Sequence
  Description of Artificial Sequence: Synthetic peptide
  MAGE-A1
RVRFFFPSL

SEQ ID NO: 255 - protein, 9 aa, Artificial Sequence
  Description of Artificial Sequence: Synthetic peptide
  MAGE-A1
SAYGEPRKL

SEQ ID NO: 256 - protein, 15 aa, Artificial Sequence
  Description of Artificial Sequence: Synthetic peptide
  MAGE-A1
TSCILESLFRAVITK

SEQ ID NO: 257 - protein, 15 aa, Artificial Sequence
  Description of Artificial Sequence: Synthetic peptide
  MAGE-A1
PRALAETSYVKVLEY

SEQ ID NO: 258 - protein, 16 aa, Artificial Sequence
  Description of Artificial Sequence: Synthetic peptide
  MAGE-A1
FLLLKYRAREPVTKAE

SEQ ID NO: 259 - protein, 12 aa, Artificial Sequence
  Description of Artificial Sequence: Synthetic peptide
  MAGE-A1
EYVIKVSARVRF

SEQ ID NO: 260 - protein, 10 aa, Artificial Sequence
  Description of Artificial Sequence: Synthetic peptide
  MAGE-A2
YLQLVFGIEV

SEQ ID NO: 261 - protein, 9 aa, Artificial Sequence
  Description of Artificial Sequence: Synthetic peptide
  MAGE-A2
EYLQLVFGI

SEQ ID NO: 262 - protein, 10 aa, Artificial Sequence
  Description of Artificial Sequence: Synthetic peptide
  MAGE-A2
REPVTKAEML

SEQ ID NO: 263 - protein, 9 aa, Artificial Sequence
  Description of Artificial Sequence: Synthetic peptide
  MAGE-A2
EGDCAPEEK

SEQ ID NO: 264 - protein, 14 aa, Artificial Sequence
  Description of Artificial Sequence: Synthetic peptide
  MAGE-A2
LLKYRAREPVTKAE

SEQ ID NO: 265 - protein, 9 aa, Artificial Sequence
  Description of Artificial Sequence: Synthetic peptide
  MAGE-A3
EVDPIGHLY

SEQ ID NO: 266 - protein, 10 aa, Artificial Sequence
  Description of Artificial Sequence: Synthetic peptide
  MAGE-A3
FLWGPRALVD

SEQ ID NO: 267 - protein, 9 aa, Artificial Sequence
  Description of Artificial Sequence: Synthetic peptide
  MAGE-A3
KVAELVHFL

SEQ ID NO: 268 - protein, 9 aa, Artificial Sequence
  Description of Artificial Sequence: Synthetic peptide
  MAGE-A3
TFPDLESEF

SEQ ID NO: 269 - protein, 9 aa, Artificial Sequence
  Description of Artificial Sequence: Synthetic peptide
  MAGE-A3
VAELVHFLL

SEQ ID NO: 270 - protein, 10 aa, Artificial Sequence
  Description of Artificial Sequence: Synthetic peptide
  MAGE-A3
MEVDPIGHLY

SEQ ID NO: 271 - protein, 9 aa, Artificial Sequence
  Description of Artificial Sequence: Synthetic peptide
  MAGE-A3
EVDPIGHLY

SEQ ID NO: 272 - protein, 10 aa, Artificial Sequence
  Description of Artificial Sequence: Synthetic peptide
  MAGE-A3
REPVTKAEML

SEQ ID NO: 273 - protein, 10 aa, Artificial Sequence
  Description of Artificial Sequence: Synthetic peptide
  MAGE-A3
AELVHFLLLI

SEQ ID NO: 274 - protein, 10 aa, Artificial Sequence
  Description of Artificial Sequence: Synthetic peptide
  MAGE-A3
MEVDPIGHLY

SEQ ID NO: 275 - protein, 9 aa, Artificial Sequence
  Description of Artificial Sequence: Synthetic peptide
  MAGE-A3
WQYFFPVIF

SEQ ID NO: 276 - protein, 9 aa, Artificial Sequence
  Description of Artificial Sequence: Synthetic peptide
  MAGE-A3
EGDCAPEEK

SEQ ID NO: 277 - protein, 16 aa, Artificial Sequence
  Description of Artificial Sequence: Synthetic peptide
  MAGE-A3
KKLLTQHFVQENYLEY

SEQ ID NO: 278 - protein, 15 aa, Artificial Sequence
  Description of Artificial Sequence: Synthetic peptide
  MAGE-A3
RKVAELVHFLLLKYR

SEQ ID NO: 279 - protein, 16 aa, Artificial Sequence
  Description of Artificial Sequence: Synthetic peptide
  MAGE-A3
KKLLTQHFVQENYLEY

SEQ ID NO: 280 - protein, 16 aa, Artificial Sequence
  Description of Artificial Sequence: Synthetic peptide
  MAGE-A3
ACYEFLWGPRALVETS

SEQ ID NO: 281 - protein, 15 aa, Artificial Sequence
  Description of Artificial Sequence: Synthetic peptide
  MAGE-A3
RKVAELVHFLLLKYR

SEQ ID NO: 282 - protein, 12 aa, Artificial Sequence
  Description of Artificial Sequence: Synthetic peptide
  MAGE-A3
VIFSKASSSLQL

SEQ ID NO: 283 - protein, 15 aa, Artificial Sequence
  Description of Artificial Sequence: Synthetic peptide
  MAGE-A3
VFGIELMEVDPIGHL

SEQ ID NO: 284 - protein, 15 aa, Artificial Sequence
  Description of Artificial Sequence: Synthetic peptide
  MAGE-A3
GDNQIMPKAGLLIIV

SEQ ID NO: 285 - protein, 15 aa, Artificial Sequence
  Description of Artificial Sequence: Synthetic peptide
  MAGE-A3
TSYVKVLHHMVKISG

SEQ ID NO: 286 - protein, 16 aa, Artificial Sequence
  Description of Artificial Sequence: Synthetic peptide
  MAGE-A3
RKVAELVHFLLLKYRA

SEQ ID NO: 287 - protein, 16 aa, Artificial Sequence
  Description of Artificial Sequence: Synthetic peptide
  MAGE-A3
FLLLKYRAREPVTKAE

SEQ ID NO: 288 - protein, 9 aa, Artificial Sequence
  Description of Artificial Sequence: Synthetic peptide
  MAGE-A4
EVDPASNTY

SEQ ID NO: 289 - protein, 10 aa, Artificial Sequence
  Description of Artificial Sequence: Synthetic peptide
  MAGE-A4
GVYDGREHTV

SEQ ID NO: 290 - protein, 9 aa, Artificial Sequence
  Description of Artificial Sequence: Synthetic peptide
  MAGE-A4
NYKRCFPVI

SEQ ID NO: 291 - protein, 8 aa, Artificial Sequence
  Description of Artificial Sequence: Synthetic peptide
  MAGE-A4
SESLKMIF

SEQ ID NO: 292 - protein, 9 aa, Artificial Sequence
  Description of Artificial Sequence: Synthetic peptide
  MAGE-A6
MVKISGGPR

SEQ ID NO: 293 - protein, 9 aa, Artificial Sequence
  Description of Artificial Sequence: Synthetic peptide
  MAGE-A6
EVDPIGHVY

SEQ ID NO: 294 - protein, 10 aa, Artificial Sequence
  Description of Artificial Sequence: Synthetic peptide
  MAGE-A6
REPVTKAEML

SEQ ID NO: 295 - protein, 9 aa, Artificial Sequence
  Description of Artificial Sequence: Synthetic peptide
  MAGE-A6
EGDCAPEEK

SEQ ID NO: 296 - protein, 9 aa, Artificial Sequence
  Description of Artificial Sequence: Synthetic peptide
  MAGE-A6
ISGGPRISY

SEQ ID NO: 297 - protein, 14 aa, Artificial Sequence
  Description of Artificial Sequence: Synthetic peptide
  MAGE-A6
LLKYRAREPVTKAE

SEQ ID NO: 298 - protein, 9 aa, Artificial Sequence
  Description of Artificial Sequence: Synthetic peptide
  MAGE-A9
ALSVMGVYV

SEQ ID NO: 299 - protein, 10 aa, Artificial Sequence
  Description of Artificial Sequence: Synthetic peptide
  MAGE-A10
GLYDGMEHLL

SEQ ID NO: 300 - protein, 9 aa, Artificial Sequence
  Description of Artificial Sequence: Synthetic peptide
  MAGE-A10
DPARYEFLW

SEQ ID NO: 301 - protein, 10 aa, Artificial Sequence
  Description of Artificial Sequence: Synthetic peptide
  MAGE-A12 m
FLWGPRALVE

SEQ ID NO: 302 - protein, 9 aa, Artificial Sequence
  Description of Artificial Sequence: Synthetic peptide
  MAGE-A12 m
VRIGHLYIL

SEQ ID NO: 303 - protein, 9 aa, Artificial Sequence
  Description of Artificial Sequence: Synthetic peptide
  MAGE-A12 m
EGDCAPEEK

SEQ ID NO: 304 - protein, 15 aa, Artificial Sequence
  Description of Artificial Sequence: Synthetic peptide
  MAGE-A12 m
REPFTKAEMLGSVIR

SEQ ID NO: 305 - protein, 14 aa, Artificial Sequence
  Description of Artificial Sequence: Synthetic peptide
  MAGE-A12 m
AELVHFLLLKYRAR

SEQ ID NO: 306 - protein, 10 aa, Artificial Sequence
  Description of Artificial Sequence: Synthetic peptide
  MAGE-C1
ILFGISLREV

SEQ ID NO: 307 - protein, 9 aa, Artificial Sequence
  Description of Artificial Sequence: Synthetic peptide
  MAGE-C1
KVVEFLAML

SEQ ID NO: 308 - protein, 13 aa, Artificial Sequence
  Description of Artificial Sequence: Synthetic peptide
  MAGE-C1
SSALLSIFQSSPE

SEQ ID NO: 309 - protein, 9 aa, Artificial Sequence
  Description of Artificial Sequence: Synthetic peptide
  MAGE-C1
SFSYTLLSL

SEQ ID NO: 310 - protein, 9 aa, Artificial Sequence
  Description of Artificial Sequence: Synthetic peptide
  MAGE-C1
VSSFFSYTL

SEQ ID NO: 311 - protein, 10 aa, Artificial Sequence
  Description of Artificial Sequence: Synthetic peptide
  MAGE-C2
LLFGLALIEV

SEQ ID NO: 312 - protein, 9 aa, Artificial Sequence
  Description of Artificial Sequence: Synthetic peptide
  MAGE-C2
ALKDVEERV

SEQ ID NO: 313 - protein, 9 aa, Artificial Sequence
  Description of Artificial Sequence: Synthetic peptide
  MAGE-C2
SESIKKKVL

SEQ ID NO: 314 - protein, 9 aa, Artificial Sequence
  Description of Artificial Sequence: Synthetic peptide
  MAGE-C2
ASSTLYLVF

SEQ ID NO: 315 - protein, 15 aa, Artificial Sequence
  Description of Artificial Sequence: Synthetic peptide
  MAGE-C2
SSTLYLVFSPSSFST

SEQ ID NO: 316 - protein, 20 aa, Artificial Sequence
  Description of Artificial Sequence: Synthetic peptide
  mucink
PDTRPAPGSTAPPAHGVTSA

SEQ ID NO: 317 - protein, 9 aa, Artificial Sequence
  Description of Artificial Sequence: Synthetic peptide
  NA88-A
QGQHFLQKV

SEQ ID NO: 318 - protein, 9 aa, Artificial Sequence
  Description of Artificial Sequence: Synthetic peptide
  NY-ESO-1 / LAGE-2
SLLMWITQC

SEQ ID NO: 319 - protein, 11 aa, Artificial Sequence
  Description of Artificial Sequence: Synthetic peptide
  NY-ESO-1 / LAGE-2
MLMAQEALAFL

SEQ ID NO: 320 - protein, 11 aa, Artificial Sequence
  Description of Artificial Sequence: Synthetic peptide
  NY-ESO-1 / LAGE-2
YLAMPFATPME

SEQ ID NO: 321 - protein, 10 aa, Artificial Sequence
  Description of Artificial Sequence: Synthetic peptide
  NY-ESO-1 / LAGE-2
ASGPGGGAPR

SEQ ID NO: 322 - protein, 10 aa, Artificial Sequence
  Description of Artificial Sequence: Synthetic peptide
  NY-ESO-1 / LAGE-2
LAAQERRVPR

SEQ ID NO: 323 - protein, 10 aa, Artificial Sequence
  Description of Artificial Sequence: Synthetic peptide
  NY-ESO-1 / LAGE-2
TVSGNILTIR

SEQ ID NO: 324 - protein, 13 aa, Artificial Sequence
  Description of Artificial Sequence: Synthetic peptide
  NY-ESO-1 / LAGE-2
APRGPHGGAASGL

SEQ ID NO: 325 - protein, 11 aa, Artificial Sequence
  Description of Artificial Sequence: Synthetic peptide
  NY-ESO-1 / LAGE-2
MPFATPMEAEL

SEQ ID NO: 326 - protein, 12 aa, Artificial Sequence
  Description of Artificial Sequence: Synthetic peptide
  NY-ESO-1 / LAGE-2
KEFTVSGNILTI

SEQ ID NO: 327 - protein, 9 aa, Artificial Sequence
  Description of Artificial Sequence: Synthetic peptide
  NY-ESO-1 / LAGE-2
MPFATPMEA

SEQ ID NO: 328 - protein, 9 aa, Artificial Sequence
  Description of Artificial Sequence: Synthetic peptide
  NY-ESO-1 / LAGE-2
FATPMEAEL

SEQ ID NO: 329 - protein, 11 aa, Artificial Sequence
  Description of Artificial Sequence: Synthetic peptide
  NY-ESO-1 / LAGE-2
FATPMEAELAR

SEQ ID NO: 330 - protein, 9 aa, Artificial Sequence
  Description of Artificial Sequence: Synthetic peptide
  NY-ESO-1 / LAGE-2
LAMPFATPM

SEQ ID NO: 331 - protein, 9 aa, Artificial Sequence
  Description of Artificial Sequence: Synthetic peptide
  NY-ESO-1 / LAGE-2
ARGPESRLL

SEQ ID NO: 332 - protein, 14 aa, Artificial Sequence
  Description of Artificial Sequence: Synthetic peptide
  NY-ESO-1 / LAGE-2
SLLMWITQCFLPVF

SEQ ID NO: 333 - protein, 25 aa, Artificial Sequence
  Description of Artificial Sequence: Synthetic peptide
  NY-ESO-1 / LAGE-2
LLEFYLAMPFATPMEAELARRSLAQ

SEQ ID NO: 334 - protein, 12 aa, Artificial Sequence
  Description of Artificial Sequence: Synthetic peptide
  NY-ESO-1 / LAGE-2
EFYLAMPFATPM

SEQ ID NO: 335 - protein, 25 aa, Artificial Sequence
  Description of Artificial Sequence: Synthetic peptide
  NY-ESO-1 / LAGE-2
PGVLLKEFTVSGNILTIRLTAADHR

SEQ ID NO: 336 - protein, 12 aa, Artificial Sequence
  Description of Artificial Sequence: Synthetic peptide
  NY-ESO-1 / LAGE-2
RLLEFYLAMPFA

SEQ ID NO: 337 - protein, 20 aa, Artificial Sequence
  Description of Artificial Sequence: Synthetic peptide
  NY-ESO-1 / LAGE-2
QGAMLAAQERRVPRAAEVPR

SEQ ID NO: 338 - protein, 13 aa, Artificial Sequence
  Description of Artificial Sequence: Synthetic peptide
  NY-ESO-1 / LAGE-2
PFATPMEAELARR

SEQ ID NO: 339 - protein, 20 aa, Artificial Sequence
  Description of Artificial Sequence: Synthetic peptide
  NY-ESO-1 / LAGE-2
PGVLLKEFTVSGNILTIRLT

SEQ ID NO: 340 - protein, 10 aa, Artificial Sequence
  Description of Artificial Sequence: Synthetic peptide
  NY-ESO-1 / LAGE-2
VLLKEFTVSG

SEQ ID NO: 341 - protein, 18 aa, Artificial Sequence
  Description of Artificial Sequence: Synthetic peptide
  NY-ESO-1 / LAGE-2
AADHRQLQLSISSCLQQL

SEQ ID NO: 342 - protein, 25 aa, Artificial Sequence
  Description of Artificial Sequence: Synthetic peptide
  NY-ESO-1 / LAGE-2
LLEFYLAMPFATPMEAELARRSLAQ

SEQ ID NO: 343 - protein, 15 aa, Artificial Sequence
  Description of Artificial Sequence: Synthetic peptide
  NY-ESO-1 / LAGE-2
LKEFTVSGNILTIRL

SEQ ID NO: 344 - protein, 25 aa, Artificial Sequence
  Description of Artificial Sequence: Synthetic peptide
  NY-ESO-1 / LAGE-2
PGVLLKEFTVSGNILTIRLTAADHR

SEQ ID NO: 345 - protein, 11 aa, Artificial Sequence
  Description of Artificial Sequence: Synthetic peptide
  NY-ESO-1 / LAGE-2
KEFTVSGNILT

SEQ ID NO: 346 - protein, 14 aa, Artificial Sequence
  Description of Artificial Sequence: Synthetic peptide
  NY-ESO-1 / LAGE-2
LLEFYLAMPFATPM

SEQ ID NO: 347 - protein, 14 aa, Artificial Sequence
  Description of Artificial Sequence: Synthetic peptide
  NY-ESO-1 / LAGE-2
AGATGGRGPRGAGA

SEQ ID NO: 348 - protein, 9 aa, Artificial Sequence
  Description of Artificial Sequence: Synthetic peptide
  SAGE
LYATVIHDI

SEQ ID NO: 349 - protein, 9 aa, Artificial Sequence
  Description of Artificial Sequence: Synthetic peptide
  Sp17
ILDSSEEDK

SEQ ID NO: 350 - protein, 9 aa, Artificial Sequence
  Description of Artificial Sequence: Synthetic peptide
  SSX-2
KASEKIFYV

SEQ ID NO: 351 - protein, 16 aa, Artificial Sequence
  Description of Artificial Sequence: Synthetic peptide
  SSX-2
EKIQKAFDDIAKYFSK

SEQ ID NO: 352 - protein, 11 aa, Artificial Sequence
  Description of Artificial Sequence: Synthetic peptide
  SSX-2
FGRLQGISPKI

SEQ ID NO: 353 - protein, 18 aa, Artificial Sequence
  Description of Artificial Sequence: Synthetic peptide
  SSX-2
WEKMKASEKIFYVYMKRK

SEQ ID NO: 354 - protein, 15 aa, Artificial Sequence
  Description of Artificial Sequence: Synthetic peptide
  SSX-2
KIFYVYMKRKYEAMT

SEQ ID NO: 355 - protein, 14 aa, Artificial Sequence
  Description of Artificial Sequence: Synthetic peptide
  SSX-2
KIFYVYMKRKYEAM

SEQ ID NO: 356 - protein, 20 aa, Artificial Sequence
  Description of Artificial Sequence: Synthetic peptide
  SSX-4
INKTSGPKRGKHAWTHRLRE

SEQ ID NO: 357 - protein, 20 aa, Artificial Sequence
  Description of Artificial Sequence: Synthetic peptide
  SSX-4
YFSKKEWEKMKSSEKIVYVY

SEQ ID NO: 358 - protein, 20 aa, Artificial Sequence
  Description of Artificial Sequence: Synthetic peptide
  SSX-4
MKLNYEVMTKLGFKVTLPPF

SEQ ID NO: 359 - protein, 20 aa, Artificial Sequence
  Description of Artificial Sequence: Synthetic peptide
  SSX-4
KHAWTHRLRERKQLVVYEEI

SEQ ID NO: 360 - protein, 20 aa, Artificial Sequence
  Description of Artificial Sequence: Synthetic peptide
  SSX-4
LGFKVTLPPFMRSKRAADFH

SEQ ID NO: 361 - protein, 20 aa, Artificial Sequence
  Description of Artificial Sequence: Synthetic peptide
  SSX-4
KSSEKIVYVYMKLNYEVMTK

SEQ ID NO: 362 - protein, 20 aa, Artificial Sequence
  Description of Artificial Sequence: Synthetic peptide
  SSX-4
KHAWTHRLRERKQLVVYEEI

SEQ ID NO: 363 - protein, 9 aa, Artificial Sequence
  Description of Artificial Sequence: Synthetic peptide
  TAG-1
SLGWLFLLL

SEQ ID NO: 364 - protein, 9 aa, Artificial Sequence
  Description of Artificial Sequence: Synthetic peptide
  TAG-1
LSRLSNRLL

SEQ ID NO: 365 - protein, 15 aa, Artificial Sequence
  Description of Artificial Sequence: Synthetic peptide
  TRAG-3
CEFHACWPAFTVLGE

SEQ ID NO: 366 - protein, 15 aa, Artificial Sequence
  Description of Artificial Sequence: Synthetic peptide
  TRAG-3
CEFHACWPAFTVLGE

SEQ ID NO: 367 - protein, 10 aa, Artificial Sequence
  Description of Artificial Sequence: Synthetic peptide
  TRP2-INT2g
EVISCKLIKR

SEQ ID NO: 368 - protein, 9 aa, Artificial Sequence
  Description of Artificial Sequence: Synthetic peptide
  XAGE-1b/GAGED2a
RQKKIRIQL

SEQ ID NO: 369 - protein, 16 aa, Artificial Sequence
  Description of Artificial Sequence: Synthetic peptide
  XAGE-1b/GAGED2a
HLGSRQKKIRIQLRSQ

SEQ ID NO: 370 - protein, 17 aa, Artificial Sequence
  Description of Artificial Sequence: Synthetic peptide
  XAGE-1b/GAGED2a
CATWKVICKSCISQTPG

SEQ ID NO: 371 - protein, 10 aa, Artificial Sequence
  Description of Artificial Sequence: Synthetic peptide
  CEA
YLSGANLNLG

SEQ ID NO: 372 - protein, 9 aa, Artificial Sequence
  Description of Artificial Sequence: Synthetic peptide
  CEA
IMIGVLVGV

SEQ ID NO: 373 - protein, 9 aa, Artificial Sequence
  Description of Artificial Sequence: Synthetic peptide
  CEA
GVLVGVALI

SEQ ID NO: 374 - protein, 9 aa, Artificial Sequence
  Description of Artificial Sequence: Synthetic peptide
  CEA
HLFGYSWYK

SEQ ID NO: 375 - protein, 10 aa, Artificial Sequence
  Description of Artificial Sequence: Synthetic peptide
  CEA
QYSWFVNGTF

SEQ ID NO: 376 - protein, 9 aa, Artificial Sequence
  Description of Artificial Sequence: Synthetic peptide
  CEA
TYACFVSNL

SEQ ID NO: 377 - protein, 15 aa, Artificial Sequence
  Description of Artificial Sequence: Synthetic peptide
  CEA
AYVCGIQNSVSANRS

SEQ ID NO: 378 - protein, 25 aa, Artificial Sequence
  Description of Artificial Sequence: Synthetic peptide
  CEA
DTGFYTLHVIKSDLVNEEATGQFRV

SEQ ID NO: 379 - protein, 15 aa, Artificial Sequence
  Description of Artificial Sequence: Synthetic peptide
  CEA
YSWRINGIPQQHTQV

SEQ ID NO: 380 - protein, 13 aa, Artificial Sequence
  Description of Artificial Sequence: Synthetic peptide
  CEA
TYYRPGVNLSLSC

SEQ ID NO: 381 - protein, 13 aa, Artificial Sequence
  Description of Artificial Sequence: Synthetic peptide
  CEA
EIIYPNASLLIQN

SEQ ID NO: 382 - protein, 15 aa, Artificial Sequence
  Description of Artificial Sequence: Synthetic peptide
  CEA
YACFVSNLATGRNNS

SEQ ID NO: 383 - protein, 13 aa, Artificial Sequence
  Description of Artificial Sequence: Synthetic peptide
  CEA
LWWVNNQSLPVSP

SEQ ID NO: 384 - protein, 13 aa, Artificial Sequence
  Description of Artificial Sequence: Synthetic peptide
  CEA
EIIYPNASLLIQN

SEQ ID NO: 385 - protein, 13 aa, Artificial Sequence
  Description of Artificial Sequence: Synthetic peptide
  CEA
NSIVKSITVSASG

SEQ ID NO: 386 - protein, 9 aa, Artificial Sequence
  Description of Artificial Sequence: Synthetic peptide
  gp100 / Pmel17
KTWGQYWQV

SEQ ID NO: 387 - protein, 10 aa, Artificial Sequence
  Description of Artificial Sequence: Synthetic peptide
  gp100 / Pmel17
  MISC_FEATURE (1)..(1): May or may not be present
AMLGTHTMEV

SEQ ID NO: 388 - protein, 9 aa, Artificial Sequence
  Description of Artificial Sequence: Synthetic peptide
  gp100 / Pmel17
ITDQVPFSV

SEQ ID NO: 389 - protein, 9 aa, Artificial Sequence
  Description of Artificial Sequence: Synthetic peptide
  gp100 / Pmel17
YLEPGPVTA

SEQ ID NO: 390 - protein, 10 aa, Artificial Sequence
  Description of Artificial Sequence: Synthetic peptide
  gp100 / Pmel17
LLDGTATLRL

SEQ ID NO: 391 - protein, 10 aa, Artificial Sequence
  Description of Artificial Sequence: Synthetic peptide
  gp100 / Pmel17
VLYRYGSFSV

SEQ ID NO: 392 - protein, 10 aa, Artificial Sequence
  Description of Artificial Sequence: Synthetic peptide
  gp100 / Pmel17
SLADTNSLAV

SEQ ID NO: 393 - protein, 9 aa, Artificial Sequence
  Description of Artificial Sequence: Synthetic peptide
  gp100 / Pmel17
RLMKQDFSV

SEQ ID NO: 394 - protein, 9 aa, Artificial Sequence
  Description of Artificial Sequence: Synthetic peptide
  gp100 / Pmel17
RLPRIFCSC

SEQ ID NO: 395 - protein, 9 aa, Artificial Sequence
  Description of Artificial Sequence: Synthetic peptide
  gp100 / Pmel17
LIYRRRLMK

SEQ ID NO: 396 - protein, 9 aa, Artificial Sequence
  Description of Artificial Sequence: Synthetic peptide
  gp100 / Pmel17
ALLAVGATK

SEQ ID NO: 397 - protein, 10 aa, Artificial Sequence
  Description of Artificial Sequence: Synthetic peptide
  gp100 / Pmel17
IALNFPGSQK

SEQ ID NO: 398 - protein, 9 aa, Artificial Sequence
  Description of Artificial Sequence: Synthetic peptide
  gp100 / Pmel17
RSYVPLAHR

SEQ ID NO: 399 - protein, 9 aa, Artificial Sequence
  Description of Artificial Sequence: Synthetic peptide
  gp100 / Pmel17
ALNFPGSQK

SEQ ID NO: 400 - protein, 9 aa, Artificial Sequence
  Description of Artificial Sequence: Synthetic peptide
  gp100 / Pmel17
VYFFLPDHL

SEQ ID NO: 401 - protein, 9 aa, Artificial Sequence
  Description of Artificial Sequence: Synthetic peptide
  gp100 / Pmel17
RTKQLYPEW

SEQ ID NO: 402 - protein, 10 aa, Artificial Sequence
  Description of Artificial Sequence: Synthetic peptide
  gp100 / Pmel17
HTMEVTVYHR

SEQ ID NO: 403 - protein, 9 aa, Artificial Sequence
  Description of Artificial Sequence: Synthetic peptide
  gp100 / Pmel17
SSPGCQPPA

SEQ ID NO: 404 - protein, 10 aa, Artificial Sequence
  Description of Artificial Sequence: Synthetic peptide
  gp100 / Pmel17
VPLDCVLYRY

SEQ ID NO: 405 - protein, 9 aa, Artificial Sequence
  Description of Artificial Sequence: Synthetic peptide
  gp100 / Pmel17
LPHSSSHWL

SEQ ID NO: 406 - protein, 8 aa, Artificial Sequence
  Description of Artificial Sequence: Synthetic peptide
  gp100 / Pmel17
SNDGPTLI

SEQ ID NO: 407 - protein, 15 aa, Artificial Sequence
  Description of Artificial Sequence: Synthetic peptide
  gp100 / Pmel17
GRAMLGTHTMEVTVY

SEQ ID NO: 408 - protein, 16 aa, Artificial Sequence
  Description of Artificial Sequence: Synthetic peptide
  gp100 / Pmel17
WNRQLYPEWTEAQRLD

SEQ ID NO: 409 - protein, 18 aa, Artificial Sequence
  Description of Artificial Sequence: Synthetic peptide
  gp100 / Pmel17
TTEWVETTARELPIPEPE

SEQ ID NO: 410 - protein, 17 aa, Artificial Sequence
  Description of Artificial Sequence: Synthetic peptide
  gp100 / Pmel17
TGRAMLGTHTMEVTVYH

SEQ ID NO: 411 - protein, 9 aa, Artificial Sequence
  Description of Artificial Sequence: Synthetic peptide
  mammaglobin-A
PLLENVISK

SEQ ID NO: 412 - protein, 30 aa, Artificial Sequence
  Description of Artificial Sequence: Synthetic polypeptide
  Melan-A / MART-1
YTTAEEAAGIGILTVILGVLLLIGCWYCRR

SEQ ID NO: 413 - protein, 14 aa, Artificial Sequence
  Description of Artificial Sequence: Synthetic peptide
  Melan-A / MART-1
AAGIGILTVILGVL

SEQ ID NO: 414 - protein, 14 aa, Artificial Sequence
  Description of Artificial Sequence: Synthetic peptide
  Melan-A / MART-1
APPAYEKLPSAEQF

SEQ ID NO: 415 - protein, 23 aa, Artificial Sequence
  Description of Artificial Sequence: Synthetic peptide
  Melan-A / MART-1
RNGYRALMDKSLHVGTQCALTRR

SEQ ID NO: 416 - protein, 20 aa, Artificial Sequence
  Description of Artificial Sequence: Synthetic peptide
  Melan-A / MART-1
MPREDAHFIYGYPKKGHGHS

SEQ ID NO: 417 - protein, 20 aa, Artificial Sequence
  Description of Artificial Sequence: Synthetic peptide
  Melan-A / MART-1
KNCEPVVPNAPPAYEKLSAE

SEQ ID NO: 418 - protein, 9 aa, Artificial Sequence
  Description of Artificial Sequence: Synthetic peptide
  NY-BR-1
SLSKILDTV

SEQ ID NO: 419 - protein, 9 aa, Artificial Sequence
  Description of Artificial Sequence: Synthetic peptide
  OA1
LYSACFWWL

SEQ ID NO: 420 - protein, 9 aa, Artificial Sequence
  Description of Artificial Sequence: Synthetic peptide
  PAP
FLFLLFFWL

SEQ ID NO: 421 - protein, 9 aa, Artificial Sequence
  Description of Artificial Sequence: Synthetic peptide
  PAP
TLMSAMTNL

SEQ ID NO: 422 - protein, 9 aa, Artificial Sequence
  Description of Artificial Sequence: Synthetic peptide
  PAP
ALDVYNGLL

SEQ ID NO: 423 - protein, 10 aa, Artificial Sequence
  Description of Artificial Sequence: Synthetic peptide
  PSA
FLTPKKLQCV

SEQ ID NO: 424 - protein, 10 aa, Artificial Sequence
  Description of Artificial Sequence: Synthetic peptide
  PSA
VISNDVCAQV

SEQ ID NO: 425 - protein, 9 aa, Artificial Sequence
  Description of Artificial Sequence: Synthetic peptide
  RAB38 / NY-MEL-1
VLHWDPETV

SEQ ID NO: 426 - protein, 9 aa, Artificial Sequence
  Description of Artificial Sequence: Synthetic peptide
  TRP-1 / gp75
MSLQRQFLR

SEQ ID NO: 427 - protein, 21 aa, Artificial Sequence
  Description of Artificial Sequence: Synthetic peptide
  TRP-1 / gp75
ISPNSVFSQWRVVCDSLEDYD

SEQ ID NO: 428 - protein, 10 aa, Artificial Sequence
  Description of Artificial Sequence: Synthetic peptide
  TRP-1 / gp75
SLPYWNFATG

SEQ ID NO: 429 - protein, 15 aa, Artificial Sequence
  Description of Artificial Sequence: Synthetic peptide
  TRP-1 / gp75
SQWRVVCDSLEDYDT

SEQ ID NO: 430 - protein, 9 aa, Artificial Sequence
  Description of Artificial Sequence: Synthetic peptide
  TRP-2
SVYDFFVWL

SEQ ID NO: 431 - protein, 9 aa, Artificial Sequence
  Description of Artificial Sequence: Synthetic peptide
  TRP-2
TLDSQVMSL

SEQ ID NO: 432 - protein, 9 aa, Artificial Sequence
  Description of Artificial Sequence: Synthetic peptide
  TRP-2
LLGPGRPYR

SEQ ID NO: 433 - protein, 9 aa, Artificial Sequence
  Description of Artificial Sequence: Synthetic peptide
  TRP-2
ANDPIFVVL

SEQ ID NO: 434 - protein, 15 aa, Artificial Sequence
  Description of Artificial Sequence: Synthetic peptide
  TRP-2
QCTEVRADTRPWSGP

SEQ ID NO: 435 - protein, 10 aa, Artificial Sequence
  Description of Artificial Sequence: Synthetic peptide
  TRP-2
ALPYWNFATG

SEQ ID NO: 436 - protein, 9 aa, Artificial Sequence
  Description of Artificial Sequence: Synthetic peptide
  tyrosinase
KCDICTDEY

SEQ ID NO: 437 - protein, 11 aa, Artificial Sequence
  Description of Artificial Sequence: Synthetic peptide
  tyrosinase
SSDYVIPIGTY

SEQ ID NO: 438 - protein, 9 aa, Artificial Sequence
  Description of Artificial Sequence: Synthetic peptide
  tyrosinase
MLLAVLYCL

SEQ ID NO: 439 - protein, 10 aa, Artificial Sequence
  Description of Artificial Sequence: Synthetic peptide
  tyrosinase
CLLWSFQTSA

SEQ ID NO: 440 - protein, 9 aa, Artificial Sequence
  Description of Artificial Sequence: Synthetic peptide
  tyrosinase
YMDGTMSQV

SEQ ID NO: 441 - protein, 9 aa, Artificial Sequence
  Description of Artificial Sequence: Synthetic peptide
  tyrosinase
AFLPWHRLF

SEQ ID NO: 442 - protein, 11 aa, Artificial Sequence
  Description of Artificial Sequence: Synthetic peptide
  tyrosinase
IYMDGTADFSF

SEQ ID NO: 443 - protein, 9 aa, Artificial Sequence
  Description of Artificial Sequence: Synthetic peptide
  tyrosinase
QCSGNFMGF

SEQ ID NO: 444 - protein, 12 aa, Artificial Sequence
  Description of Artificial Sequence: Synthetic peptide
  tyrosinase
TPRLPSSADVEF

SEQ ID NO: 445 - protein, 9 aa, Artificial Sequence
  Description of Artificial Sequence: Synthetic peptide
  tyrosinase
LPSSADVEF

SEQ ID NO: 446 - protein, 10 aa, Artificial Sequence
  Description of Artificial Sequence: Synthetic peptide
  tyrosinase
LHHAFVDSIF

SEQ ID NO: 447 - protein, 10 aa, Artificial Sequence
  Description of Artificial Sequence: Synthetic peptide
  tyrosinase
SEIWRDIDFD

SEQ ID NO: 448 - protein, 15 aa, Artificial Sequence
  Description of Artificial Sequence: Synthetic peptide
  tyrosinase
QNILLSNAPLGPQFP

SEQ ID NO: 449 - protein, 13 aa, Artificial Sequence
  Description of Artificial Sequence: Synthetic peptide
  tyrosinase
SYLQDSDPDSFQD

SEQ ID NO: 450 - protein, 21 aa, Artificial Sequence [sequence omitted]

SEQ ID NO: 451 - protein, 9 aa, Artificial Sequence
  Description of Artificial Sequence: Synthetic peptide
  adipophilin
SVASTITGV

SEQ ID NO: 452 - protein, 10 aa, Artificial Sequence
  Description of Artificial Sequence: Synthetic peptide
  AIM-2
RSDSGQQARY

SEQ ID NO: 453 - protein, 9 aa, Artificial Sequence
  Description of Artificial Sequence: Synthetic peptide
  ALDH1A1
LLYKLADLI

SEQ ID NO: 454 - protein, 10 aa, Artificial Sequence
  Description of Artificial Sequence: Synthetic peptide
  BCLX(L)
YLNDHLEPWI

SEQ ID NO: 455 - protein, 9 aa, Artificial Sequence
  Description of Artificial Sequence: Synthetic peptide
  BING-4
CQWGRLWQL

SEQ ID NO: 456 - protein, 10 aa, Artificial Sequence
  Description of Artificial Sequence: Synthetic peptide
  CALCA
VLLQAGSLHA

SEQ ID NO: 457 - protein, 9 aa, Artificial Sequence
  Description of Artificial Sequence: Synthetic peptide
  CD45
KFLDALISL

SEQ ID NO: 458 - protein, 9 aa, Artificial Sequence
  Description of Artificial Sequence: Synthetic peptide
  CD274
LLNAFTVTV

SEQ ID NO: 459 - protein, 9 aa, Artificial Sequence
  Description of Artificial Sequence: Synthetic peptide
  CPSF
KVHPVIWSL

SEQ ID NO: 460 - protein, 10 aa, Artificial Sequence
  Description of Artificial Sequence: Synthetic peptide
  peptide
LMLQNALTTM

SEQ ID NO: 461 - protein, 9 aa, Artificial Sequence
  Description of Artificial Sequence: Synthetic peptide
  cyclinD1
LLGATCMFV

SEQ ID NO: 462 - protein, 15 aa, Artificial Sequence
  Description of Artificial Sequence: Synthetic peptide
  peptide
NPPSMVAAGSVVAAV

SEQ ID NO: 463 - protein, 10 aa, Artificial Sequence
  Description of Artificial Sequence: Synthetic peptide
  DKK1
ALGGHPLLGV

SEQ ID NO: 464 - protein, 9 aa, Artificial Sequence
  Description of Artificial Sequence: Synthetic peptide
  ENAH(hMena)
TMNGSKSPV

SEQ ID NO: 465 - protein, 9 aa, Artificial Sequence
  Description of Artificial Sequence: Synthetic peptide
  EpCAM
RYQLDPKFI

SEQ ID NO: 466 - protein, 12 aa, Artificial Sequence
  Description of Artificial Sequence: Synthetic peptide
  EphA3
DVTFNIICKKCG

SEQ ID NO: 467 - protein, 9 aa, Artificial Sequence
  Description of Artificial Sequence: Synthetic peptide
  EZH2
FMVEDETVL

SEQ ID NO: 468 - protein, 10 aa, Artificial Sequence
  Description of Artificial Sequence: Synthetic peptide
  FGF5
NTYASPRFKF

SEQ ID NO: 469 - protein, 9 aa, Artificial Sequence
  Description of Artificial Sequence: Synthetic peptide
  glypican-3
FVGEFFTDV

SEQ ID NO: 470 - protein, 9 aa, Artificial Sequence
  Description of Artificial Sequence: Synthetic peptide
  G250 / MN / CAIX
HLSTAFARV

SEQ ID NO: 471 - protein, 9 aa, Artificial Sequence
  Description of Artificial Sequence: Synthetic peptide
  HER-2 / neu
KIFGSLAFL

SEQ ID NO: 472 - protein, 9 aa, Artificial Sequence
  Description of Artificial Sequence: Synthetic peptide
  HER-2 / neu
IISAVVGIL

SEQ ID NO: 473 - protein, 9 aa, Artificial Sequence
  Description of Artificial Sequence: Synthetic peptide
  HER-2 / neu
ALCRWGLLL

SEQ ID NO: 474 - protein, 9 aa, Artificial Sequence
  Description of Artificial Sequence: Synthetic peptide
  HER-2 / neu
ILHNGAYSL

SEQ ID NO: 475 - protein, 9 aa, Artificial Sequence
  Description of Artificial Sequence: Synthetic peptide
  HER-2 / neu
RLLQETELV

SEQ ID NO: 476 - protein, 9 aa, Artificial Sequence
  Description of Artificial Sequence: Synthetic peptide
  HER-2 / neu
VVLGVVFGI

SEQ ID NO: 477 - protein, 10 aa, Artificial Sequence
  Description of Artificial Sequence: Synthetic peptide
  HER-2 / neu
YMIMVKCWMI

SEQ ID NO: 478 - protein, 9 aa, Artificial Sequence
  Description of Artificial Sequence: Synthetic peptide
  HER-2 / neu
HLYQGCQVV

SEQ ID NO: 479 - protein, 10 aa, Artificial Sequence
  Description of Artificial Sequence: Synthetic peptide
  HER-2 / neu
YLVPQQGFFC

SEQ ID NO: 480 - protein, 9 aa, Artificial Sequence
  Description of Artificial Sequence: Synthetic peptide
  HER-2 / neu
PLQPEQLQV

SEQ ID NO: 481 - protein, 9 aa, Artificial Sequence
  Description of Artificial Sequence: Synthetic peptide
  HER-2 / neu
TLEEITGYL

SEQ ID NO: 482 - protein, 9 aa, Artificial Sequence
  Description of Artificial Sequence: Synthetic peptide
  HER-2 / neu
ALIHHNTHL

SEQ ID NO: 483 - protein, 9 aa, Artificial Sequence
  Description of Artificial Sequence: Synthetic peptide
  HER-2 / neu
PLTSIISAV

SEQ ID NO: 484 - protein, 9 aa, Artificial Sequence
  Description of Artificial Sequence: Synthetic peptide
  HER-2 / neu
VLRENTSPK

SEQ ID NO: 485 - protein, 9 aa, Artificial Sequence
  Description of Artificial Sequence: Synthetic peptide
  HER-2 / neu
TYLPTNASL

SEQ ID NO: 486 - protein, 9 aa, Artificial Sequence
  Description of Artificial Sequence: Synthetic peptide
  HLA-DOB
FLLGLIFLL

SEQ ID NO: 487 - protein, 9 aa, Artificial Sequence
  Description of Artificial Sequence: Synthetic peptide
  Hepsin
SLLSGDWVL

SEQ ID NO: 488 - protein, 9 aa, Artificial Sequence
  Description of Artificial Sequence: Synthetic peptide
  Hepsin
GLQLGVQAV

SEQ ID NO: 489 - protein, 9 aa, Artificial Sequence
  Description of Artificial Sequence: Synthetic peptide
  Hepsin
PLTEYIQPV

SEQ ID NO: 490 - protein, 9 aa, Artificial Sequence
  Description of Artificial Sequence: Synthetic peptide
  IDO1
ALLEIASCL

SEQ ID NO: 491 - protein, 9 aa, Artificial Sequence
  Description of Artificial Sequence: Synthetic peptide
  IGF2B3
NLSSAEVVV

SEQ ID NO: 492 - protein, 9 aa, Artificial Sequence
  Description of Artificial Sequence: Synthetic peptide
  IGF2B3
RLLVPTQFV

SEQ ID NO: 493 - protein, 9 aa, Artificial Sequence
  Description of Artificial Sequence: Synthetic peptide
  IL13Ralpha2
WLPFGFILI

SEQ ID NO: 494 - protein, 9 aa, Artificial Sequence
  Description of Artificial Sequence: Synthetic peptide
  Intestinal carboxyl esterase
SPRWWPTCL

SEQ ID NO: 495 - protein, 9 aa, Artificial Sequence
  Description of Artificial Sequence: Synthetic peptide
  alpha-foetoprotein
GVALQTMKQ

SEQ ID NO: 496 - protein, 9 aa, Artificial Sequence
  Description of Artificial Sequence: Synthetic peptide
  alpha-foetoprotein
FMNKFIYEI

SEQ ID NO: 497 - protein, 10 aa, Artificial Sequence
  Description of Artificial Sequence: Synthetic peptide
  alpha-foetoprotein
QLAVSVILRV

SEQ ID NO: 498 - protein, 9 aa, Artificial Sequence
  Description of Artificial Sequence: Synthetic peptide
  Kallikrein 4
FLGYLILGV

SEQ ID NO: 499 - protein, 15 aa, Artificial Sequence
  Description of Artificial Sequence: Synthetic peptide
  Kallikrein 4
SVSESDTIRSISIAS

SEQ ID NO: 500 - protein, 15 aa, Artificial Sequence
  Description of Artificial Sequence: Synthetic peptide
  Kallikrein 4
LLANGRMPTVLQCVN

SEQ ID NO: 501 - protein, 15 aa, Artificial Sequence
  Description of Artificial Sequence: Synthetic peptide
  Kallikrein 4
RMPTVLQCVNVSVVS

SEQ ID NO: 502 - protein, 9 aa, Artificial Sequence
  Description of Artificial Sequence: Synthetic peptide
  KIF20A
LLSDDDVVV

SEQ ID NO: 503 - protein, 10 aa, Artificial Sequence
  Description of Artificial Sequence: Synthetic peptide
  KIF20A
AQPDTAPLPV

SEQ ID NO: 504 - protein, 9 aa, Artificial Sequence
  Description of Artificial Sequence: Synthetic peptide
  KIF20A
CIAEQYHTV

SEQ ID NO: 505 - protein, 10 aa, Artificial Sequence
  Description of Artificial Sequence: Synthetic peptide
  Lengsin
FLPEFGISSA

SEQ ID NO: 506 - protein, 14 aa, Artificial Sequence
  Description of Artificial Sequence: Synthetic peptide
  M-CSF
LPAVVGLSPGEQEY

SEQ ID NO: 507 - protein, 16 aa, Artificial Sequence
  Description of Artificial Sequence: Synthetic peptide
  MCSP
VGQDVSVLFRVTGALQ

SEQ ID NO: 508 - protein, 8 aa, Artificial Sequence
  Description of Artificial Sequence: Synthetic peptide
  mdm-2
VLFYLGQY

SEQ ID NO: 509 - protein, 9 aa, Artificial Sequence
  Description of Artificial Sequence: Synthetic peptide
  Meloe
TLNDECWPA

SEQ ID NO: 510 - protein, 14 aa, Artificial Sequence
  Description of Artificial Sequence: Synthetic peptide
  Meloe
ERISSTLNDECWPA

SEQ ID NO: 511 - protein, 11 aa, Artificial Sequence
  Description of Artificial Sequence: Synthetic peptide
  Meloe
FGRLQGISPKI

SEQ ID NO: 512 - protein, 13 aa, Artificial Sequence
  Description of Artificial Sequence: Synthetic peptide
  Meloe
TSREQFLPSEGAA

SEQ ID NO: 513 - protein, 14 aa, Artificial Sequence
  Description of Artificial Sequence: Synthetic peptide
  Meloe
CPPWHPSERISSTL

SEQ ID NO: 514 - protein, 9 aa, Artificial Sequence
  Description of Artificial Sequence: Synthetic peptide
  Midkine
ALLALTSAV

SEQ ID NO: 515 - protein, 9 aa, Artificial Sequence
  Description of Artificial Sequence: Synthetic peptide
  Midkine
AQCQETIRV

SEQ ID NO: 516 - protein, 15 aa, Artificial Sequence
  Description of Artificial Sequence: Synthetic peptide
  Midkine
LTLLALLALTSAVAK

SEQ ID NO: 517 - protein, 10 aa, Artificial Sequence
  Description of Artificial Sequence: Synthetic peptide
  MMP-2
GLPPDVQRVH

SEQ ID NO: 518 - protein, 12 aa, Artificial Sequence
  Description of Artificial Sequence: Synthetic peptide
  MMP-7
SLFPNSPKWTSK

SEQ ID NO: 519 - protein, 9 aa, Artificial Sequence
  Description of Artificial Sequence: Synthetic peptide
  MUC1
STAPPVHNV

SEQ ID NO: 520 - protein, 9 aa, Artificial Sequence
  Description of Artificial Sequence: Synthetic peptide
  MUC1
LLLLTVLTV

SEQ ID NO: 521 - protein, 12 aa, Artificial Sequence
  Description of Artificial Sequence: Synthetic peptide
  MUC1
PGSTAPPAHGVT

SEQ ID NO: 522 - protein, 9 aa, Artificial Sequence
  Description of Artificial Sequence: Synthetic peptide
  MUC5AC
TCQPTCRSL

SEQ ID NO: 523 - protein, 9 aa, Artificial Sequence
  Description of Artificial Sequence: Synthetic peptide
  p53
LLGRNSFEV

SEQ ID NO: 524 - protein, 9 aa, Artificial Sequence
  Description of Artificial Sequence: Synthetic peptide
  p53
RMPEAAPPV

SEQ ID NO: 525 - protein, 9 aa, Artificial Sequence
  Description of Artificial Sequence: Synthetic peptide
  p53
SQKTYQGSY

SEQ ID NO: 526 - protein, 13 aa, Artificial Sequence
  Description of Artificial Sequence: Synthetic peptide
  p53
PGTRVRAMAIYKQ

SEQ ID NO: 527 - protein, 12 aa, Artificial Sequence
  Description of Artificial Sequence: Synthetic peptide
  p53
HLIRVEGNLRVE

SEQ ID NO: 528 - protein, 9 aa, Artificial Sequence
  Description of Artificial Sequence: Synthetic peptide
  PAX5
TLPGYPPHV

SEQ ID NO: 529 - protein, 12 aa, Artificial Sequence
  Description of Artificial Sequence: Synthetic peptide
  PBF
CTACRWKKACQR

SEQ ID NO: 530 - protein, 9 aa, Artificial Sequence
  Description of Artificial Sequence: Synthetic peptide
  PRAME
VLDGLDVLL

SEQ ID NO: 531 - protein, 10 aa, Artificial Sequence
  Description of Artificial Sequence: Synthetic peptide
  PRAME
SLYSFPEPEA

SEQ ID NO: 532 - protein, 10 aa, Artificial Sequence
  Description of Artificial Sequence: Synthetic peptide
  PRAME
ALYVDSLFFL

SEQ ID NO: 533 - protein, 9 aa, Artificial Sequence
  Description of Artificial Sequence: Synthetic peptide
  PRAME
SLLQHLIGL

SEQ ID NO: 534 - protein, 10 aa, Artificial Sequence
  Description of Artificial Sequence: Synthetic peptide
  PRAME
LYVDSLFFLC

SEQ ID NO: 535 - protein, 9 aa, Artificial Sequence
  Description of Artificial Sequence: Synthetic peptide
  PSMA
NYARTEDFF

SEQ ID NO: 536 - protein, 9 aa, Artificial Sequence
  Description of Artificial Sequence: Synthetic peptide
  RAGE-1
LKLSGVVRL

SEQ ID NO: 537 - protein, 11 aa, Artificial Sequence
  Description of Artificial Sequence: Synthetic peptide
  RAGE-1
PLPPARNGGLG

SEQ ID NO: 538 - protein, 10 aa, Artificial Sequence
  Description of Artificial Sequence: Synthetic peptide
  RAGE-1
SPSSNRIRNT

SEQ ID NO: 539 - protein, 9 aa, Artificial Sequence
  Description of Artificial Sequence: Synthetic peptide
  RGS5
LAALPHSCL

SEQ ID NO: 540 - protein, 10 aa, Artificial Sequence
  Description of Artificial Sequence: Synthetic peptide
  RGS5
GLASFKSFLK

SEQ ID NO: 541 - protein, 10 aa, Artificial Sequence
  Description of Artificial Sequence: Synthetic peptide
  RhoC
RAGLQVRKNK

SEQ ID NO: 542 - protein, 10 aa, Artificial Sequence
  Description of Artificial Sequence: Synthetic peptide
  RNF43
  MISC_FEATURE (10)..(10): May or may not be present
ALWPWLLMAT

SEQ ID NO: 543 - protein, 9 aa, Artificial Sequence
  Description of Artificial Sequence: Synthetic peptide
  RNF43
NSQPVWLCL

SEQ ID NO: 544 - protein, 9 aa, Artificial Sequence
  Description of Artificial Sequence: Synthetic peptide
  RU2AS
LPRWPPPQL

SEQ ID NO: 545 - protein, 9 aa, Artificial Sequence
  Description of Artificial Sequence: Synthetic peptide
  secernin1
KMDAEHPEL

SEQ ID NO: 546 - protein, 9 aa, Artificial Sequence
  Description of Artificial Sequence: Synthetic peptide
  SOX10
AWISKPPGV

SEQ ID NO: 547 - protein, 10 aa, Artificial Sequence
  Description of Artificial Sequence: Synthetic peptide
  SOX10
SAWISKPPGV

SEQ ID NO: 548 - protein, 9 aa, Artificial Sequence
  Description of Artificial Sequence: Synthetic peptide
  STEAP1
MIAVFLPIV

SEQ ID NO: 549 - protein, 15 aa, Artificial Sequence
  Description of Artificial Sequence: Synthetic peptide
  STEAP1
HQQYFYKIPILVINK

SEQ ID NO: 550 - protein, 10 aa, Artificial Sequence
  Description of Artificial Sequence: Synthetic peptide
  survivin
ELTLGEFLKL

SEQ ID NO: 551 - protein, 15 aa, Artificial Sequence
  Description of Artificial Sequence: Synthetic peptide
  survivin
TLGEFLKLDRERAKN

SEQ ID NO: 552 - protein, 10 aa, Artificial Sequence
  Description of Artificial Sequence: Synthetic peptide
  Telomerase
ILAKFLHWLE

SEQ ID NO: 553 - protein, 9 aa, Artificial Sequence
  Description of Artificial Sequence: Synthetic peptide
  Telomerase
RLVDDFLLV

SEQ ID NO: 554 - protein, 15 aa, Artificial Sequence
  Description of Artificial Sequence: Synthetic peptide
  Telomerase
RPGLLGASVLGLDDI

SEQ ID NO: 555 - protein, 15 aa, Artificial Sequence
  Description of Artificial Sequence: Synthetic peptide
  Telomerase
LTDLQPYMRQFVAHL

SEQ ID NO: 556 - protein, 9 aa, Artificial Sequence
  Description of Artificial Sequence: Synthetic peptide
  TPBG
RLARLALVL

SEQ ID NO: 557 - protein, 9 aa, Artificial Sequence
  Description of Artificial Sequence: Synthetic peptide
  VEGF
SRFGGAVVR

SEQ ID NO: 558 - protein, 11 aa, Artificial Sequence
  Description of Artificial Sequence: Synthetic peptide
  WT1
TSEKRPFMCAY

SEQ ID NO: 559 - protein, 9 aa, Artificial Sequence
  Description of Artificial Sequence: Synthetic peptide
  WT1
CMTWNQMNL

SEQ ID NO: 560 - protein, 11 aa, Artificial Sequence
  Description of Artificial Sequence: Synthetic peptide
  WT1
LSHLQMHSRKH

SEQ ID NO: 561 - protein, 16 aa, Artificial Sequence
  Description of Artificial Sequence: Synthetic peptide
  WT1
KRYFKLSHLQMHSRKH

SEQ ID NO: 562 - protein, 504 aa, Artificial Sequence
  Description of Artificial Sequence: Synthetic polypeptide
  single chain variable fragment fusion protein
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 563 - DNA, 290 bp, Artificial Sequence
  Description of Artificial Sequence: Synthetic polynucleotide
  FNR Responsive Promoter
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaa

SEQ ID NO: 564 - DNA, 173 bp, Artificial Sequence
  Description of Artificial Sequence: Synthetic polynucleotide
  FNR Responsive Promoter
atttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacct

SEQ ID NO: 565 - DNA, 305 bp, Artificial Sequence
  Description of Artificial Sequence: Synthetic polynucleotide
  FNR Responsive Promoter
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacat

SEQ ID NO: 566 - DNA, 180 bp, Artificial Sequence
  Description of Artificial Sequence: Synthetic polynucleotide
  FNR Responsive Promoter
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacat

SEQ ID NO: 567 - DNA, 199 bp, Artificial Sequence
  Description of Artificial Sequence: Synthetic polynucleotide
  FNR Responsive Promoter
agttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacat

SEQ ID NO: 568 - DNA, 117 bp, Artificial Sequence
  Description of Artificial Sequence: Synthetic polynucleotide
  FNR-responsive regulatory region
atccccatcactcttgatggagatcaattccccaagctgctagagcgttaccttgcccttaaacattagcaatgtcgatttatcagagggccgacaggctcccacaggagaaaaccg

SEQ ID NO: 569 - DNA, 108 bp, Artificial Sequence
  Description of Artificial Sequence: Synthetic polynucleotide
  FNR-responsive regulatory region
ctcttgatcgttatcaattcccacgctgtttcagagcgttaccttgcccttaaacattagcaatgtcgatttatcagagggccgacaggctcccacaggagaaaaccg

SEQ ID NO: 570 - DNA, 290 bp, Artificial Sequence; identical to SEQ ID NO: 563
  Description of Artificial Sequence: Synthetic polynucleotide
  nirB1 , FNR-responsive regulatory region

SEQ ID NO: 571 - DNA, 433 bp, Artificial Sequence
  Description of Artificial Sequence: Synthetic polynucleotide
  nirB2 , FNR-responsive regulatory region
cggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgtttgtttaactttaagaaggagatatacat

SEQ ID NO: 572 - DNA, 290 bp, Artificial Sequence
  Description of Artificial Sequence: Synthetic polynucleotide
  nirB3 , FNR-responsive regulatory region
gtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaa

SEQ ID NO: 573 - DNA, 173 bp, Artificial Sequence; identical to SEQ ID NO: 564
  Description of Artificial Sequence: Synthetic polynucleotide
  ydfZ , FNR-responsive regulatory region

SEQ ID NO: 574 - DNA, 305 bp, Artificial Sequence; identical to SEQ ID NO: 565
  Description of Artificial Sequence: Synthetic polynucleotide
  nirB+RBS , FNR-responsive regulatory region

SEQ ID NO: 575 - DNA, 180 bp, Artificial Sequence; identical to SEQ ID NO: 566
  Description of Artificial Sequence: Synthetic polynucleotide
  ydfZ+RBS , FNR-responsive regulatory region

SEQ ID NO: 576 - DNA, 199 bp, Artificial Sequence; identical to SEQ ID NO: 567
  Description of Artificial Sequence: Synthetic polynucleotide
  FNRS1 , FNR-responsive regulatory region

SEQ ID NO: 577 - DNA, 207 bp, Artificial Sequence
  Description of Artificial Sequence: Synthetic polynucleotide
  FNRS2 , FNR-responsive regulatory region
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 578 - DNA, 390 bp, Artificial Sequence
  Description of Artificial Sequence: Synthetic polynucleotide
  nirB+crp , FNR-responsive regulatory region
tcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtagaaatgtgatctagttcacatttgcggtaatagaaaagaaatcgaggcaaaaatgtttgtttaactttaagaaggagatatacat

SEQ ID NO: 579 - DNA, 200 bp, Artificial Sequence
  Description of Artificial Sequence: Synthetic polynucleotide
  FNRS+crp , FNR-responsive regulatory region
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcaaatgtgatctagttcacattttttgtttaactttaagaaggagatatacat

SEQ ID NO: 580 - DNA, 355 bp, Artificial Sequence
  Description of Artificial Sequence: Synthetic polynucleotide
  katG, Regulatory sequence
tgtggcttttatgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgcgaattcattaaagaggagaaaggtacc

SEQ ID NO: 581 - DNA, 228 bp, Artificial Sequence
  Description of Artificial Sequence: Synthetic polynucleotide
  Dps, Regulatory sequence
ttccgaaaattcctggcgagcagataaataagaattgttcttatcaatatatctaactcattgaatctttattagttttgtttttcacgcttgttaccactattagtgtgataggaacagccagaatagcggaacacatagccggtgctatacttaatctcgttaattactgggacataacatcaagaggatatgaaattcgaattcattaaagaggagaaaggtacc

SEQ ID NO: 582 - DNA, 334 bp, Artificial Sequence
  Description of Artificial Sequence: Synthetic polynucleotide
  ahpC, Regulatory sequence
gcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgcgaattcattaaagaggagaaaggtacc

SEQ ID NO: 583 - DNA, 134 bp, Artificial Sequence
  Description of Artificial Sequence: Synthetic polynucleotide
  oxyS Regulatory sequence
ctcgagttcattatccatcctccatcgccacgatagttcatggcgataggtagaatagcaatgaacgattatccctatcaagcattctgactgataattgctcacacgaattcattaaagaggagaaaggtacc

SEQ ID NO: 584 - DNA, 1921 bp, Artificial Sequence
  Description of Artificial Sequence: Synthetic polynucleotide
  Prp (Propionate)
ttacccgtctggattttcagtacgcgcttttaaacgacgccacagcgtggtacggctgatccccaaataacgtgcggcggcgcgcttatcgccattaaagcgtgcgagcacctcctgcaatggaagcgcttctgctgacgagggcgtgatttctgctgtggtccccaccagttcaggtaataattgccgcataaattgtctgtccagtgttggtgcgggatcgacgcttaaaaaaagcgccaggcgttccatcatattccgcagttcgcgaatattaccgggccaatgatagttcagtagaagcggctgacactgcgtcagcccatgacgcaccgattcggtaaaagggatctccatcgcggccagcgattgttttaaaaagttttccgccagaggcagaatatcaggctgtcgctcgcgcaaggggggaagcggcagacgcagaatgctcaaacggtaaaacagatcggtacgaaaacgtccttgcgttatctcccgatccagatcgcaatgcgtggcgctgatcacccggacatctaccgggatcggctgatgcccgccaacgcgggtgacggctttttcctccagtacgcgtagaaggcgggtttgtaacggcagcggcatttcgccaatttcgtcaagaaacagcgtgccgccgtgggcgacctcaaacagccccgcacgtccacctcgtcttgagccggtaaacgctccctcctcatagccaaacagttcagcctccagcaacgactcggtaatcgcgccgcaattaacggcgacaaagggcggagaaggcttgttctgacggtggggctgacggttaaacaacgcctgatgaatcgcttgcgccgccagctctttcccggtccctgtttccccctgaatcagcactgccgcgcgggaacgggcatagagtgtaatcgtatggcgaacctgctccatttgtggtgaatcgccgaggatatcgctcagcgcataacgggtctgtaatcccttgctggaggtatgctggctatactgacgccgtgtcaggcgggtcatatccagcgcatcatggaaagcctgacgtacggtggccgctgaataaataaagatggcggtcattcctgcctcttccgccaggtcggtaattagtcctgccccaattacagcctcaatgccgttagctttgagctcgttaatttgcccgcgagcatcctcttcagtgatatagcttcgctgttcaagacggaggtgaaacgttttctgaaaggcgaccagagccggaatggtctcctgataggtcacgattcccattgaggaagtcagctttcccgcttttgccagagcctgtaatacatcgaatccgctgggtttgatgaggatgacaggtaccgacagtcggctttttaaataagcgccgttggaacctgccgcgataatcgcgtcgcagcgttcggttgccagttttttgcgaatgtaggctactgccttttcaaaaccgagctgaataggcgtgatcgtcgccagatgatcaaactccaggctgatatcccgaaatagttcgaacaggcgcgttaccgagaccgtccagatcaccggtttatcgctattatcgcgcgaagcgctatgcacagtaaccatcgtcgtagattcatgtttaaggaacgaattcttgttttatagatgtttcgttaatgttgcaatgaaacacaggcctccgtttcatgaaacgttagctgactcgtttttcttgtgactcgtctgtcagtattaaaaaagatttttcatttaactgattgtttttaaattgaattttatttaatggtttctcggtttttgggtctggcatatcccttgctttaatgagtgcatcttaattaacaattcaataacaagagggctgaatagtaatttcaacaaaataacgagcattcgaatg

SEQ ID NO: 585 - DNA, 305 bp, Artificial Sequence
  Description of Artificial Sequence: Synthetic polynucleotide
  Arabinose Promoter region
cagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatccagcctgacgctttttttcgcaactctctactgtttctccatacctctagaaataattttgtttaactttaagaaggagatatacat

SEQ ID NO: 586 - DNA, 897 bp, Artificial Sequence
  Description of Artificial Sequence: Synthetic polynucleotide
  AraC (reverse orientation)
ttattcacaacctgccctaaactcgctcggactcgccccggtgcattttttaaatactcgcgagaaatagagttgatcgtcaaaaccgacattgcgaccgacggtggcgataggcatccgggtggtgctcaaaagcagcttcgcctgactgatgcgctggtcctcgcgccagcttaatacgctaatccctaactgctggcggaacaaatgcgacagacgcgacggcgacaggcagacatgctgtgcgacgctggcgatatcaaaattactgtctgccaggtgatcgctgatgtactgacaagcctcgcgtacccgattatccatcggtggatggagcgactcgttaatcgcttccatgcgccgcagtaacaattgctcaagcagatttatcgccagcaattccgaatagcgcccttccccttgtccggcattaatgatttgcccaaacaggtcgctgaaatgcggctggtgcgcttcatccgggcgaaagaaaccggtattggcaaatatcgacggccagttaagccattcatgccagtaggcgcgcggacgaaagtaaacccactggtgataccattcgtgagcctccggatgacgaccgtagtgatgaatctctccaggcgggaacagcaaaatatcacccggtcggcagacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcgttaaacgagtatcccggcagcaggggatcattttgcgcttcagccatacttttcatactcccgccattcagagaagaaaccaattgtccatattgcat

SEQ ID NO: 587 - protein, 298 aa, Artificial Sequence
  Description of Artificial Sequence: Synthetic polypeptide
  AraC polypeptide
MQYGQLVSSLNGGSMKSMAEAQNDPLLPGYSFNAHLVAGLTPIEANGYLDFFIDRPLGMKGYILNLTIRGQGVVKNQGREFVCRPGDILLFPPGEIHHYGRHPEAHEWYHQWVYFRPRAYWHEWLNWPSIFANTGFFRPDEAHQPHFSDLFGQIINAGQGEGRYSELLAINLLEQLLLRRMEAINESLHPPMDNRVREACQYISDHLADSNFDIASVAQHVCLSPSRLSHLFRQQLGISVLSWREDQRISQAKLLLSTTRMPIATVGRNVGFDDQLYFSRVFKKCTGASPSEFRAGCE

SEQ ID NO: 588 - DNA, 280 bp, Artificial Sequence
  Description of Artificial Sequence: Synthetic polynucleotide
  Region comprising rhamnose inducible promoter
cggtgagcatcacatcaccacaattcagcaaattgtgaacatcatcacgttcatctttccctggttgccaatggcccattttcctgtcagtaacgagaaggtcgcgaatcaggcgctttttagactggtcgtaatgaaattcagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 589 - DNA, 326 bp, Artificial Sequence
  Description of Artificial Sequence: Synthetic polynucleotide
  Lac Promoter region
attcaccaccctgaattgactctcttccgggcgctatcatgccataccgcgaaaggttttgcgccattcgatggcgcgccgcttcgtcaggccacatagctttcttgttctgatcggaacgatcgttggctgtgttgacaattaatcatcggctcgtataatgtgtggaattgtgagcgctcacaattagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 590 - DNA, 1083 bp, Artificial Sequence
  Description of Artificial Sequence: Synthetic polynucleotide
  LacI (in reverse orientation)
tcactgcccgctttccagtcgggaaacctgtcgtgccagctgcattaatgaatcggccaacgcgcggggagaggcggtttgcgtattgggcgccagggtggtttttcttttcaccagtgagactggcaacagctgattgcccttcaccgcctggccctgagagagttgcagcaagcggtccacgctggtttgccccagcaggcgaaaatcctgtttgatggtggttaacggcgggatataacatgagctatcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcctcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcat

SEQ ID NO: 591 - protein, 360 aa, Artificial Sequence
  Description of Artificial Sequence: Synthetic polypeptide
  LacI polypeptide sequence
MKPVTLYDVAEYAGVSYQTVSRVVNQASHVSAKTREKVEAAMAELNYIPNRVAQQLAGKQSLLIGVATSSLALHAPSQIVAAIKSRADQLGASVVVSMVERSGVEACKAAVHNLLAQRVSGLIINYPLDDQDAIAVEAACTNVPALFLDVSDQTPINSIIFSHEDGTRLGVEHLVALGHQQIALLAGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLAPNTQTASPRALADSLMQLARQVSRLESGQ

SEQ ID NO: 592 - DNA, 222 bp, Artificial Sequence
  Description of Artificial Sequence: Synthetic polynucleotide
  Region comprising Temperature sensitive promoter
acgttaaatctatcaccgcaagggataaatatctaacaccgtgcgtgttgactattttacctctggcggtgataatggttgcatagctgtcaccggatgtgctttccggtctgatgagtccgtgaggacgaaacagcctctacaaataattttgtttaaaacaacacccactaagataactctagaaataattttgtttaactttaagaaggagatatacat

SEQ ID NO: 593 - DNA, 714 bp, Artificial Sequence
  Description of Artificial Sequence: Synthetic polynucleotide
  mutant cI857 repressor
tcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggcttttttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcat

SEQ ID NO: 594 - DNA, 43 bp, Artificial Sequence
  Description of Artificial Sequence: Synthetic oligonucleotide
  RBS and leader region
ctctagaaataattttgtttaactttaagaaggagatatacat

SEQ ID NO: 595 - protein, 237 aa, Artificial Sequence
  Description of Artificial Sequence: Synthetic polypeptide
  mutant cI857 repressor polypeptide sequence
MSTKKKPLTQEQLEDARRLKAIYEKKKNELGLSQESVADKMGMGQSGVGALFNGINALNAYNAALLTKILKVSVEEFSPSIAREIYEMYEAVSMQPSLRSEYEYPVFSHVQAGMFSPKLRTFTKGDAERWVSTTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 596 - DNA, 748 bp, Artificial Sequence
  Description of Artificial Sequence: Synthetic polynucleotide
  TetR-Tet promoter construct
ttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacat

SEQ ID NO: 597 - DNA, 225 bp, Artificial Sequence
  Description of Artificial Sequence: Synthetic polynucleotide
  PssB promoter
tcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattc

SEQ ID NO: 598 - DNA, 30 bp, Artificial Sequence
  Description of Artificial Sequence: Synthetic oligonucleotide
  BBa_I14018
gtttatacataggcgagtactctgttatgg

SEQ ID NO: 599 - DNA, 30 bp, Artificial Sequence
  Description of Artificial Sequence: Synthetic oligonucleotide
  BBa_I14033
agaggttccaactttcaccataatgaaaca

SEQ ID NO: 600 - DNA, 30 bp, Artificial Sequence
  Description of Artificial Sequence: Synthetic oligonucleotide
  BBa_I14034
taaacaactaacggacaattctacctaaca

SEQ ID NO: 601 - DNA, 30 bp, Artificial Sequence
  Description of Artificial Sequence: Synthetic oligonucleotide
  BBa_I732021
acatcaagccaaattaaacaggattaacac

SEQ ID NO: 602 - DNA, 30 bp, Artificial Sequence
  Description of Artificial Sequence: Synthetic oligonucleotide
  BBa_I742126
gaggtaaaatagtcaacacgcacggtgtta

SEQ ID NO: 603 - DNA, 30 bp, Artificial Sequence
  Description of Artificial Sequence: Synthetic oligonucleotide
  BBa_J01006
caggccggaataactccctataatgcgcca

SEQ ID NO: 604 - DNA, 30 bp, Artificial Sequence
  Description of Artificial Sequence: Synthetic oligonucleotide
  BBa_J23100
ggctagctcagtcctaggtacagtgctagc

SEQ ID NO: 605 - DNA, 30 bp, Artificial Sequence
  Description of Artificial Sequence: Synthetic oligonucleotide
  BBa_J23101
agctagctcagtcctaggtattatgctagc

SEQ ID NO: 606 - DNA, 30 bp, Artificial Sequence
  Description of Artificial Sequence: Synthetic oligonucleotide
  BBa_J23102
agctagctcagtcctaggtactgtgctagc

SEQ ID NO: 607 - DNA, 30 bp, Artificial Sequence
  Description of Artificial Sequence: Synthetic oligonucleotide
  BBa_J23103
agctagctcagtcctagggattatgctagc

SEQ ID NO: 608 - DNA, 30 bp, Artificial Sequence
  Description of Artificial Sequence: Synthetic oligonucleotide
  BBa_J23104
agctagctcagtcctaggtattgtgctagc

SEQ ID NO: 609 - DNA, 30 bp, Artificial Sequence
  Description of Artificial Sequence: Synthetic oligonucleotide
  BBa_J23105
ggctagctcagtcctaggtactatgctagc

SEQ ID NO: 610 - DNA, 30 bp, Artificial Sequence
  Description of Artificial Sequence: Synthetic oligonucleotide
  BBa_J23106
ggctagctcagtcctaggtatagtgctagc

SEQ ID NO: 611 - DNA, 30 bp, Artificial Sequence
  Description of Artificial Sequence: Synthetic oligonucleotide
  BBa_J23107
ggctagctcagccctaggtattatgctagc

SEQ ID NO: 612 - DNA, 30 bp, Artificial Sequence
  Description of Artificial Sequence: Synthetic oligonucleotide
  BBa_J23108
agctagctcagtcctaggtataatgctagc

SEQ ID NO: 613 - DNA, 30 bp, Artificial Sequence
  Description of Artificial Sequence: Synthetic oligonucleotide
  BBa_J23109
agctagctcagtcctagggactgtgctagc

SEQ ID NO: 614 - DNA, 30 bp, Artificial Sequence
  Description of Artificial Sequence: Synthetic oligonucleotide
  BBa_J23110
ggctagctcagtcctaggtacaatgctagc

SEQ ID NO: 615 - DNA, 30 bp, Artificial Sequence; identical to SEQ ID NO: 610
  Description of Artificial Sequence: Synthetic oligonucleotide
  BBa_J23111

SEQ ID NO: 616 - DNA, 30 bp, Artificial Sequence; identical to SEQ ID NO: 607
  Description of Artificial Sequence: Synthetic oligonucleotide
  BBa_J23112

SEQ ID NO: 617 - DNA, 30 bp, Artificial Sequence
  Description of Artificial Sequence: Synthetic oligonucleotide
  BBa_J23113
ggctagctcagtcctagggattatgctagc

SEQ ID NO: 618 - DNA, 30 bp, Artificial Sequence; identical to SEQ ID NO: 614
  Description of Artificial Sequence: Synthetic oligonucleotide
  BBa_J23114

SEQ ID NO: 619 - DNA, 30 bp, Artificial Sequence
  Description of Artificial Sequence: Synthetic oligonucleotide
  BBa_J23115
agctagctcagcccttggtacaatgctagc

SEQ ID NO: 620 - DNA, 30 bp, Artificial Sequence
  Description of Artificial Sequence: Synthetic oligonucleotide
  BBa_J23116
agctagctcagtcctagggactatgctagc

SEQ ID NO: 621 - DNA, 30 bp, Artificial Sequence
  Description of Artificial Sequence: Synthetic oligonucleotide
  BBa_J23117
agctagctcagtcctagggattgtgctagc

SEQ ID NO: 622 - DNA, 30 bp, Artificial Sequence
  Description of Artificial Sequence: Synthetic oligonucleotide
  BBa_J23118
ggctagctcagtcctaggtattgtgctagc

SEQ ID NO: 623 - DNA, 30 bp, Artificial Sequence; identical to SEQ ID NO: 612
  Description of Artificial Sequence: Synthetic oligonucleotide
  BBa_J23119

SEQ ID NO: 624 - DNA, 30 bp, Artificial Sequence
  Description of Artificial Sequence: Synthetic oligonucleotide
  BBa_J23150
ggctagctcagtcctaggtattatgctagc

SEQ ID NO: 625 - DNA, 30 bp, Artificial Sequence; identical to SEQ ID NO: 614
  Description of Artificial Sequence: Synthetic oligonucleotide
  BBa_J23151

SEQ ID NO: 626 - DNA, 30 bp, Artificial Sequence
  Description of Artificial Sequence: Synthetic oligonucleotide
  BBa_J44002
aaagtgtgacgccgtgcaaataatcaatgt

SEQ ID NO: 627 - DNA, 30 bp, Artificial Sequence
  Description of Artificial Sequence: Synthetic oligonucleotide
  BBa_J48104
gacgaatacttaaaatcgtcatacttattt

SEQ ID NO: 628 - DNA, 30 bp, Artificial Sequence
  Description of Artificial Sequence: Synthetic oligonucleotide
  BBa_J54200
aaacctttcgcggtatggcatgatagcgcc

SEQ ID NO: 629 - DNA, 30 bp, Artificial Sequence
  Description of Artificial Sequence: Synthetic oligonucleotide
  BBa_J56015
tgatagcgcccggaagagagtcaattcagg

SEQ ID NO: 630 - DNA, 30 bp, Artificial Sequence
  Description of Artificial Sequence: Synthetic oligonucleotide
  BBa_J64951
ttatttaccgtgacgaactaattgctcgtg

SEQ ID NO: 631 - DNA, 30 bp, Artificial Sequence
  Description of Artificial Sequence: Synthetic oligonucleotide
  BBa_K088007
catacgccgttatacgttgtttacgctttg

SEQ ID NO: 632 - DNA, 30 bp, Artificial Sequence
  Description of Artificial Sequence: Synthetic oligonucleotide
  BBa_K119000
ttatgcttccggctcgtatgttgtgtggac

SEQ ID NO: 633 - DNA, 30 bp, Artificial Sequence
  Description of Artificial Sequence: Synthetic oligonucleotide
  BBa_K119001
ttatgcttccggctcgtatggtgtgtggac

SEQ ID NO: 634 - DNA, 30 bp, Artificial Sequence; identical to SEQ ID NO: 609
  Description of Artificial Sequence: Synthetic oligonucleotide
  BBa_K1330002

SEQ ID NO: 635 - DNA, 30 bp, Artificial Sequence
  Description of Artificial Sequence: Synthetic oligonucleotide
  BBa_K137029
atatatatatatatataatggaagcgtttt

SEQ ID NO: 636 - DNA, 30 bp, Artificial Sequence; identical to SEQ ID NO: 635
  Description of Artificial Sequence: Synthetic oligonucleotide
  BBa_K137030

SEQ ID NO: 637 - DNA, 30 bp, Artificial Sequence
  Description of Artificial Sequence: Synthetic oligonucleotide
  BBa_K137031
ccccgaaagcttaagaatataattgtaagc

SEQ ID NO: 638 - DNA, 30 bp, Artificial Sequence; identical to SEQ ID NO: 637
  Description of Artificial Sequence: Synthetic oligonucleotide
  BBa_K137032

SEQ ID NO: 639 - DNA, 30 bp, Artificial Sequence
  Description of Artificial Sequence: Synthetic oligonucleotide
  BBa_K137085
tgacaatatatatatatatataatgctagc

SEQ ID NO: 640 - DNA, 30 bp, Artificial Sequence
  Description of Artificial Sequence: Synthetic oligonucleotide
  BBa_K137086
acaatatatatatatatatataatgctagc

SEQ ID NO: 641 - DNA, 30 bp, Artificial Sequence
  Description of Artificial Sequence: Synthetic oligonucleotide
  BBa_K137087
aatatatatatatatatatataatgctagc

SEQ ID NO: 642 - DNA, 30 bp, Artificial Sequence
  Description of Artificial Sequence: Synthetic oligonucleotide
  BBa_K137088
tatatatatatatatatatataatgctagc

SEQ ID NO: 643 - DNA, 30 bp, Artificial Sequence; identical to SEQ ID NO: 642
  Description of Artificial Sequence: Synthetic oligonucleotide
  BBa_K137089

SEQ ID NO: 644 - DNA, 30 bp, Artificial Sequence
  Description of Artificial Sequence: Synthetic oligonucleotide
  BBa_K137090
aaaaaaaaaaaaaaaaaatataatgctagc

SEQ ID NO: 645 - DNA, 30 bp, Artificial Sequence; identical to SEQ ID NO: 644
  Description of Artificial Sequence: Synthetic oligonucleotide
  BBa_K137091

SEQ ID NO: 646 - DNA, 30 bp, Artificial Sequence
  Description of Artificial Sequence: Synthetic oligonucleotide
  BBa_K1585100
ggaattgtgagcggataacaatttcacaca

SEQ ID NO: 647 - DNA, 30 bp, Artificial Sequence; identical to SEQ ID NO: 646
  Description of Artificial Sequence: Synthetic oligonucleotide
  BBa_K1585101

SEQ ID NO: 648 - DNA, 30 bp, Artificial Sequence; identical to SEQ ID NO: 646
  Description of Artificial Sequence: Synthetic oligonucleotide
  BBa_K1585102

SEQ ID NO: 649 - DNA, 30 bp, Artificial Sequence; identical to SEQ ID NO: 646
  Description of Artificial Sequence: Synthetic oligonucleotide
  BBa_K1585103

SEQ ID NO: 650 - DNA, 30 bp, Artificial Sequence; identical to SEQ ID NO: 646
  Description of Artificial Sequence: Synthetic oligonucleotide
  BBa_K1585104

SEQ ID NO: 651 - DNA, 30 bp, Artificial Sequence; identical to SEQ ID NO: 646
  Description of Artificial Sequence: Synthetic oligonucleotide
  BBa_K1585105

SEQ ID NO: 652 - DNA, 30 bp, Artificial Sequence; identical to SEQ ID NO: 646
  Description of Artificial Sequence: Synthetic oligonucleotide
  BBa_K1585106

SEQ ID NO: 653 - DNA, 30 bp, Artificial Sequence; identical to SEQ ID NO: 646
  Description of Artificial Sequence: Synthetic oligonucleotide
  BBa_K1585110

SEQ ID NO: 654 - DNA, 30 bp, Artificial Sequence; identical to SEQ ID NO: 646
  Description of Artificial Sequence: Synthetic oligonucleotide
  BBa_K1585113

SEQ ID NO: 655 - DNA, 30 bp, Artificial Sequence; identical to SEQ ID NO: 646
  Description of Artificial Sequence: Synthetic oligonucleotide
  BBa_K1585115

SEQ ID NO: 656 - DNA, 30 bp, Artificial Sequence; identical to SEQ ID NO: 646
  Description of Artificial Sequence: Synthetic oligonucleotide
  BBa_K1585116

SEQ ID NO: 657 - DNA, 30 bp, Artificial Sequence; identical to SEQ ID NO: 646
  Description of Artificial Sequence: Synthetic oligonucleotide
  BBa_K1585117

SEQ ID NO: 658 - DNA, 30 bp, Artificial Sequence; identical to SEQ ID NO: 646
  Description of Artificial Sequence: Synthetic oligonucleotide
  BBa_K1585118

SEQ ID NO: 659 - DNA, 30 bp, Artificial Sequence; identical to SEQ ID NO: 646
  Description of Artificial Sequence: Synthetic oligonucleotide
  BBa_K1585119

SEQ ID NO: 660 - DNA, 30 bp, Artificial Sequence
  Description of Artificial Sequence: Synthetic oligonucleotide
  BBa_K1824896
gattaaagaggagaaatactagagtactag

SEQ ID NO: 661 - DNA, 30 bp, Artificial Sequence
  Description of Artificial Sequence: Synthetic oligonucleotide
  BBa_K256002
caccttcgggtgggcctttctgcgtttata

SEQ ID NO: 662 - DNA, 30 bp, Artificial Sequence; identical to SEQ ID NO: 661
  Description of Artificial Sequence: Synthetic oligonucleotide
  BBa_K256018

SEQ ID NO: 663 - DNA, 30 bp, Artificial Sequence; identical to SEQ ID NO: 661
  Description of Artificial Sequence: Synthetic oligonucleotide
  BBa_K256020

SEQ ID NO: 664 - DNA, 30 bp, Artificial Sequence; identical to SEQ ID NO: 661
  Description of Artificial Sequence: Synthetic oligonucleotide
  BBa_K256033

SEQ ID NO: 665 - DNA, 30 bp, Artificial Sequence; identical to SEQ ID NO: 604
  Description of Artificial Sequence: Synthetic oligonucleotide
  BBa_K292000

SEQ ID NO: 666 - DNA, 30 bp, Artificial Sequence
  Description of Artificial Sequence: Synthetic oligonucleotide
  BBa_K292001
tgctagctactagagattaaagaggagaaa

SEQ ID NO: 667 - DNA, 30 bp, Artificial Sequence
  Description of Artificial Sequence: Synthetic oligonucleotide
  BBa_K418000
ttgtgagcggataacaagatactgagcaca

SEQ ID NO: 668 - DNA, 30 bp, Artificial Sequence; identical to SEQ ID NO: 667
  Description of Artificial Sequence: Synthetic oligonucleotide
  BBa_K418002

SEQ ID NO: 669 - DNA, 30 bp, Artificial Sequence; identical to SEQ ID NO: 667
  Description of Artificial Sequence: Synthetic oligonucleotide
  BBa_K418003

SEQ ID NO: 670 - DNA, 30 bp, Artificial Sequence; identical to SEQ ID NO: 604
  Description of Artificial Sequence: Synthetic oligonucleotide
  BBa_K823004

SEQ ID NO: 671 - DNA, 30 bp, Artificial Sequence; identical to SEQ ID NO: 605
  Description of Artificial Sequence: Synthetic oligonucleotide
  BBa_K823005

SEQ ID NO: 672 - DNA, 30 bp, Artificial Sequence; identical to SEQ ID NO: 606
  Description of Artificial Sequence: Synthetic oligonucleotide
  BBa_K823006

SEQ ID NO: 673 - DNA, 30 bp, Artificial Sequence; identical to SEQ ID NO: 607
  Description of Artificial Sequence: Synthetic oligonucleotide
  BBa_K823007

SEQ ID NO: 674 - DNA, 30 bp, Artificial Sequence; identical to SEQ ID NO: 610
  Description of Artificial Sequence: Synthetic oligonucleotide
  BBa_K823008

SEQ ID NO: 675 - DNA, 30 bp, Artificial Sequence; identical to SEQ ID NO: 617
  Description of Artificial Sequence: Synthetic oligonucleotide
  BBa_K823010

SEQ ID NO: 676 - DNA, 30 bp, Artificial Sequence; identical to SEQ ID NO: 614
  Description of Artificial Sequence: Synthetic oligonucleotide
  BBa_K823011

SEQ ID NO: 677 - DNA, 30 bp, Artificial Sequence; identical to SEQ ID NO: 621
  Description of Artificial Sequence: Synthetic oligonucleotide
  BBa_K823013

SEQ ID NO: 678 - DNA, 30 bp, Artificial Sequence; identical to SEQ ID NO: 622
  Description of Artificial Sequence: Synthetic oligonucleotide
  BBa_K823014

SEQ ID NO: 679 - DNA, 30 bp, Artificial Sequence
  Description of Artificial Sequence: Synthetic oligonucleotide
  BBa_M13101
cctgtttttatgttattctctctgtaaagg

SEQ ID NO: 680 - DNA, 30 bp, Artificial Sequence
  Description of Artificial Sequence: Synthetic oligonucleotide
  BBa_M13102
aaatatttgcttatacaatcttcctgtttt

SEQ ID NO: 681 - DNA, 30 bp, Artificial Sequence
  Description of Artificial Sequence: Synthetic oligonucleotide
  BBa_M13103
gctgataaaccgatacaattaaaggctcct

SEQ ID NO: 682 - DNA, 30 bp, Artificial Sequence
  Description of Artificial Sequence: Synthetic oligonucleotide
  BBa_M13104
ctcttctcagcgtcttaatctaagctatcg

SEQ ID NO: 683 - DNA, 30 bp, Artificial Sequence
  Description of Artificial Sequence: Synthetic oligonucleotide
  BBa_M13105
atgagccagttcttaaaatcgcataaggta

SEQ ID NO: 684 - DNA, 30 bp, Artificial Sequence
  Description of Artificial Sequence: Synthetic oligonucleotide
  BBa_M13106
ctattgattgtgacaaaataaacttattcc

SEQ ID NO: 685 - DNA, 30 bp, Artificial Sequence
  Description of Artificial Sequence: Synthetic oligonucleotide
  BBa_M13108
gtttcgcgcttggtataatcgctgggggtc

SEQ ID NO: 686 - DNA, 30 bp, Artificial Sequence
  Description of Artificial Sequence: Synthetic oligonucleotide
  BBa_M13110
ctttgcttctgactataatagtcagggtaa

SEQ ID NO: 687 - DNA, 30 bp, Artificial Sequence
  Description of Artificial Sequence: Synthetic oligonucleotide
  BBa_M31519
aaaccgatacaattaaaggctcctgctagc

SEQ ID NO: 688 - DNA, 30 bp, Artificial Sequence
  Description of Artificial Sequence: Synthetic oligonucleotide
  BBa_R1074
caccacactgatagtgctagtgtagatcac

SEQ ID NO: 689 - DNA, 30 bp, Artificial Sequence
  Description of Artificial Sequence: Synthetic oligonucleotide
  BBa_R1075
gccggaataactccctataatgcgccacca

SEQ ID NO: 690 - DNA, 30 bp, Artificial Sequence
  Description of Artificial Sequence: Synthetic oligonucleotide
  BBa_S03331
ttgacaagcttttcctcagctccgtaaact

SEQ ID NO: 691 - DNA, 30 bp, Artificial Sequence
  Description of Artificial Sequence: Synthetic oligonucleotide
  BBa_J45992
ggtttcaaaattgtgatctatatttaacaa

SEQ ID NO: 692 - DNA, 30 bp, Artificial Sequence; identical to SEQ ID NO: 691
  Description of Artificial Sequence: Synthetic oligonucleotide
  BBa_J45993

SEQ ID NO: 693 - DNA, 30 bp, Artificial Sequence
  Description of Artificial Sequence: Synthetic oligonucleotide
  BBa_J45504
tctattccaataaagaaatcttcctgcgtg

SEQ ID NO: 694 - DNA, 30 bp, Artificial Sequence
  Description of Artificial Sequence: Synthetic oligonucleotide
  BBa_K1895002
gaccgaatatatagtggaaacgtttagatg

SEQ ID NO: 695 - DNA, 30 bp, Artificial Sequence
  Description of Artificial Sequence: Synthetic oligonucleotide
  BBa_K1895003
ccacatcctgtttttaaccttaaaatggca

SEQ ID NO: 696 - DNA, 30 bp, Artificial Sequence
  Description of Artificial Sequence: Synthetic oligonucleotide
  BBa_K143012
aaaaatgggctcgtgttgtacaataaatgt

SEQ ID NO: 697 - DNA, 30 bp, Artificial Sequence
  Description of Artificial Sequence: Synthetic oligonucleotide
  BBa_K143013
aaaaaaagcgcgcgattatgtaaaatataa

SEQ ID NO: 698 - DNA, 30 bp, Artificial Sequence
  Description of Artificial Sequence: Synthetic oligonucleotide
  BBa_K780003
aattgcagtaggcatgacaaaatggactca

SEQ ID NO: 699 - DNA, 30 bp, Artificial Sequence
  Description of Artificial Sequence: Synthetic oligonucleotide
  BBa_K823000
caagcttttcctttataatagaatgaatga

SEQ ID NO: 700 - DNA, 30 bp, Artificial Sequence
  Description of Artificial Sequence: Synthetic oligonucleotide
  BBa_K823002
tctaagctagtgtattttgcgtttaatagt

SEQ ID NO: 701 - DNA, 30 bp, Artificial Sequence
  Description of Artificial Sequence: Synthetic oligonucleotide
  BBa_K823003
aatgggctcgtgttgtacaataaatgtagt

SEQ ID NO: 702 - DNA, 30 bp, Artificial Sequence
  Description of Artificial Sequence: Synthetic oligonucleotide
  BBa_K143010
atccttatcgttatgggtattgtttgtaat

SEQ ID NO: 703 - DNA, 30 bp, Artificial Sequence
  Description of Artificial Sequence: Synthetic oligonucleotide
  BBa_K143011
taaaagaattgtgagcgggaatacaacaac

SEQ ID NO: 704 - DNA, 30 bp, Artificial Sequence; identical to SEQ ID NO: 697
  Description of Artificial Sequence: Synthetic oligonucleotide
  BBa_K143013

SEQ ID NO: 705 - DNA, 30 bp, Artificial Sequence
  Description of Artificial Sequence: Synthetic oligonucleotide
  BBa_K112706
tacaaaataattcccctgcaaacattatca

SEQ ID NO: 706 - DNA, 30 bp, Artificial Sequence
  Description of Artificial Sequence: Synthetic oligonucleotide
  BBa_K112707
tacaaaataattcccctgcaaacattatcg

SEQ ID NO: 707 - DNA, 30 bp, Artificial Sequence
  Description of Artificial Sequence: Synthetic oligonucleotide
  BBa_I712074
agggaatacaagctacttgttctttttgca

SEQ ID NO: 708 - DNA, 23 bp, Artificial Sequence
  Description of Artificial Sequence: Synthetic oligonucleotide
  BBa_I719005
taatacgactcactatagggaga

SEQ ID NO: 709 - DNA, 28 bp, Artificial Sequence
  Description of Artificial Sequence: Synthetic oligonucleotide
  BBa_J34814
gaatttaatacgactcactatagggaga

SEQ ID NO: 710 - DNA, 19 bp, Artificial Sequence
  Description of Artificial Sequence: Synthetic oligonucleotide
  BBa_J64997
taatacgactcactatagg

SEQ ID NO: 711 - DNA, 30 bp, Artificial Sequence
  Description of Artificial Sequence: Synthetic oligonucleotide
  BBa_K113010
gagtcgtattaatacgactcactatagggg

SEQ ID NO: 712 - DNA, 30 bp, Artificial Sequence
  Description of Artificial Sequence: Synthetic oligonucleotide
  BBa_K113011
agtgagtcgtactacgactcactatagggg

SEQ ID NO: 713 - DNA, 30 bp, Artificial Sequence
  Description of Artificial Sequence: Synthetic oligonucleotide
  BBa_K113012
gagtcgtattaatacgactctctatagggg

SEQ ID NO: 714 - DNA, 18 bp, Artificial Sequence
  Description of Artificial Sequence: Synthetic oligonucleotide
  BBa_K1614000
taatacgactcactatag

SEQ ID NO: 715 - DNA, 23 bp, Artificial Sequence
  Description of Artificial Sequence: Synthetic oligonucleotide
  BBa_R0085
taatacgactcactatagggaga

SEQ ID NO: 716 - DNA, 23 bp, Artificial Sequence
  Description of Artificial Sequence: Synthetic oligonucleotide
  BBa_R0180
ttatacgactcactatagggaga

SEQ ID NO: 717 - DNA, 23 bp, Artificial Sequence
  Description of Artificial Sequence: Synthetic oligonucleotide
  BBa_R0181
gaatacgactcactatagggaga

SEQ ID NO: 718 - DNA, 23 bp, Artificial Sequence
  Description of Artificial Sequence: Synthetic oligonucleotide
  BBa_R0182
taatacgtctcactatagggaga

SEQ ID NO: 719 - DNA, 23 bp, Artificial Sequence
  Description of Artificial Sequence: Synthetic oligonucleotide
  BBa_R0183
tcatacgactcactatagggaga

SEQ ID NO: 720 - DNA, 30 bp, Artificial Sequence
  Description of Artificial Sequence: Synthetic oligonucleotide
  BBa_Z0251
taatacgactcactatagggagaccacaac

SEQ ID NO: 721 - DNA, 30 bp, Artificial Sequence
  Description of Artificial Sequence: Synthetic oligonucleotide
  BBa_Z0252
taattgaactcactaaagggagaccacagc

SEQ ID NO: 722 - DNA, 30 bp, Artificial Sequence
  Description of Artificial Sequence: Synthetic oligonucleotide
  BBa_Z0253
cgaagtaatacgactcactattagggaaga

SEQ ID NO: 723 - DNA, 19 bp, Artificial Sequence
  Description of Artificial Sequence: Synthetic oligonucleotide
atttaggtgacactataga

SEQ ID NO: 724 - DNA, 30 bp, Artificial Sequence
  Description of Artificial Sequence: Synthetic oligonucleotide
  BBa_I766555
acaaacacaaatacacacactaaattaata

SEQ ID NO: 725 - DNA, 30 bp, Artificial Sequence
  Description of Artificial Sequence: Synthetic oligonucleotide
  BBa_I766556
ccaagcatacaatcaactatctcatataca

SEQ ID NO: 726 - DNA, 30 bp, Artificial Sequence
  Description of Artificial Sequence: Synthetic oligonucleotide
  BBa_I766557
gatacaggatacagcggaaacaacttttaa

SEQ ID NO: 727 - DNA, 30 bp, Artificial Sequence
  Description of Artificial Sequence: Synthetic oligonucleotide
  BBa_J63005
tttcaagctataccaagcatacaatcaact

SEQ ID NO: 728 - DNA, 30 bp, Artificial Sequence
  Description of Artificial Sequence: Synthetic oligonucleotide
  BBa_K105027
cctttgcagcataaattactatacttctat

SEQ ID NO: 729 - DNA, 30 bp, Artificial Sequence; identical to SEQ ID NO: 728
  Description of Artificial Sequence: Synthetic oligonucleotide
  BBa_K105028

SEQ ID NO: 730 - DNA, 30 bp, Artificial Sequence; identical to SEQ ID NO: 728
  Description of Artificial Sequence: Synthetic oligonucleotide
  BBa_K105029

SEQ ID NO: 731 - DNA, 30 bp, Artificial Sequence; identical to SEQ ID NO: 728
  Description of Artificial Sequence: Synthetic oligonucleotide
  BBa_K105030

SEQ ID NO: 732 - DNA, 30 bp, Artificial Sequence; identical to SEQ ID NO: 728
  Description of Artificial Sequence: Synthetic oligonucleotide
  BBa_K105031

SEQ ID NO: 733 - DNA, 30 bp, Artificial Sequence
  Description of Artificial Sequence: Synthetic oligonucleotide
  BBa_K122000
ttatctactttttacaacaaatataaaaca

SEQ ID NO: 734 - DNA, 30 bp, Artificial Sequence; identical to SEQ ID NO: 724
  Description of Artificial Sequence: Synthetic oligonucleotide
  BBa_K124000

SEQ ID NO: 735 - DNA, 30 bp, Artificial Sequence
  Description of Artificial Sequence: Synthetic oligonucleotide
  BBa_K124002
gtttcgaataaacacacataaacaaacaaa

SEQ ID NO: 736 - DNA, 30 bp, Artificial Sequence; identical to SEQ ID NO: 725
  Description of Artificial Sequence: Synthetic oligonucleotide
  BBa_K319005

SEQ ID NO: 737 - DNA, 30 bp, Artificial Sequence
  Description of Artificial Sequence: Synthetic oligonucleotide
  BBa_M31201
accatcaaaggaagctttaatcttctcata

SEQ ID NO: 738 - DNA, 30 bp, Artificial Sequence
  Description of Artificial Sequence: Synthetic oligonucleotide
  BBa_I712004
agaacccactgcttactggcttatcgaaat

SEQ ID NO: 739 - DNA, 30 bp, Artificial Sequence
  Description of Artificial Sequence: Synthetic oligonucleotide
  BBa_K076017
ggccgtttttggcttttttgttagacgaag

SEQ ID NO: 740 - DNA, 66 bp, Artificial Sequence
  Description of Artificial Sequence: Synthetic oligonucleotide
  Plpp
ataagtgccttcccatcaaaaaaatattctcaacataaaaaactttgtgtaatacttgtaacgcta

SEQ ID NO: 741 - DNA, 52 bp, Artificial Sequence
  Description of Artificial Sequence: Synthetic oligonucleotide
  PapFAB46
aaaaagagtattgacttcgcatctttttgtacctataatagattcattgcta

SEQ ID NO: 742 - DNA, 59 bp, Artificial Sequence
  Description of Artificial Sequence: Synthetic oligonucleotide
  PJ23101+UP element
ggaaaatttttttaaaaaaaaaactttacagctagctcagtcctaggtattatgctagc

SEQ ID NO: 743 - DNA, 59 bp, Artificial Sequence
  Description of Artificial Sequence: Synthetic oligonucleotide
  PJ23107+UP element
ggaaaatttttttaaaaaaaaaactttacggctagctcagccctaggtattatgctagc

SEQ ID NO: 744 - DNA, 64 bp, Artificial Sequence
  Description of Artificial Sequence: Synthetic oligonucleotide
  PSYN23119
ggaaaatttttttaaaaaaaaaacttgacagctagctcagtccttggtataatgctagcacgaa

SEQ ID NO: 745 - protein, 21 aa, Artificial Sequence
  Description of Artificial Sequence: Synthetic peptide
  PhoA
MKQSTIALALLPLLFTPVTKA

SEQ ID NO: 746 - protein, 20 aa, Artificial Sequence
  Description of Artificial Sequence: Synthetic peptide
  PhoA
KQSTIALALLPLLFTPVTKA

SEQ ID NO: 747 - protein, 22 aa, Artificial Sequence
  Description of Artificial Sequence: Synthetic peptide
  OmpF
MMKRNILAVIVPALLVAGTANA

SEQ ID NO: 748 - protein, 15 aa, Artificial Sequence
  Description of Artificial Sequence: Synthetic peptide
  cvaC
MRTLTLNELDSVSGG

SEQ ID NO: 749 - protein, 43 aa, Artificial Sequence
  Description of Artificial Sequence: Synthetic polypeptide
  TorA
MNNNDLFQASRRRFLAQLGGLTVAGMLGTSLLTPRRATAAQAA

SEQ ID NO: 750 - protein, 33 aa, Artificial Sequence
  Description of Artificial Sequence: Synthetic polypeptide
  fdnG
MDVSRRQFFKICAGGMAGTTVAALGFAPKQALA

SEQ ID NO: 751 - protein, 45 aa, Artificial Sequence
  Description of Artificial Sequence: Synthetic polypeptide
  dmsA
MKTKIPDAVLAAEVSRRGLVKTTAIGGLAMASSALTLPFSRIAHA

SEQ ID NO: 752 - protein, 21 aa, Artificial Sequence
  Description of Artificial Sequence: Synthetic peptide
  PelB
KYLLPTAAAGLLLLAAQPAMA

SEQ ID NO: 753 - protein, 52 aa, Artificial Sequence
  Description of Artificial Sequence: Synthetic polypeptide
  HlyA secretion signal
LNPLINEISKIISAAGNFDVKEERAAASLLQLSGNASDFSYGRNSITLTASA

SEQ ID NO: 754 - DNA, 159 bp, Artificial Sequence
  Description of Artificial Sequence: Synthetic polynucleotide
  HlyA secretion signal
cttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 755 - DNA, 355 bp, Artificial Sequence
  Description of Artificial Sequence: Synthetic polynucleotide
  VH (10D1)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 756 - DNA, 325 bp, Artificial Sequence
  Description of Artificial Sequence: Synthetic polynucleotide
  VL (10D1)
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 757 - DNA, 355 bp, Artificial Sequence
  Description of Artificial Sequence: Synthetic polynucleotide
  VH (4B6)
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaagcaataaacactacgcagactccgtgaagggccgattcaccgtctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 758 - DNA, 325 bp, Artificial Sequence
  Description of Artificial Sequence: Synthetic polynucleotide
  VL (4B6)
gaaattgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 759 - DNA, 358 bp, Artificial Sequence
  Description of Artificial Sequence: Synthetic polynucleotide
  VH (1E2)
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgttttactgtgcgagagctcccaattatattggtgcttttgatgtctggggccaagggacaatggtcaccgtctcttcag

SEQ ID NO: 760 - DNA, 322 bp, Artificial Sequence
  Description of Artificial Sequence: Synthetic polynucleotide
  VL (1E2)
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaac

SEQ ID NO: 761 - protein, 451 aa, Artificial Sequence
  Description of Artificial Sequence: Synthetic polypeptide
  Heavy chain (human monoclonal)
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 762 - protein, 214 aa, Artificial Sequence; identical to SEQ ID NO: 10
  Description of Artificial Sequence: Synthetic polypeptide
  Light chain (human monoclonal)

SEQ ID NO: 763 - protein, 448 aa, Artificial Sequence; identical to SEQ ID NO: 5
  Description of Artificial Sequence: Synthetic polypeptide
  Heavy chain (human monoclonal)

SEQ ID NO: 764 - protein, 215 aa, Artificial Sequence; identical to SEQ ID NO: 7
  Description of Artificial Sequence: Synthetic polypeptide
  Light chain (human monoclonal)

SEQ ID NO: 765 - protein, 242 aa, Artificial Sequence
  Description of Artificial Sequence: Synthetic polypeptide
  anti CTLA-4 scFv; Heavy Chain  linker  Light Chain Transcribed from the native FliC promoter and 5UTR (untranslated region) with an optimized ribosome binding site
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 766 - DNA, 1103 bp, Artificial Sequence
  Description of Artificial Sequence: Synthetic polynucleotide
  anti CTLA-4 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacaaataaaaatgaggaggcaattctaatgcaagtgcaactggtagagtccggtgggggcgtggtgcagccgggtcgcagcctgcgtctgtcgtgcgcggcgagtggttttacgttttcgagttatactatgcactgggttcgtcaagcgccgggcaaaggcctggaatgggttactttcatttcttacgatggtaataataaatattatgcggattctgtgaaaggtcgctttactatttcgcgcgataacagtaaaaacactctgtatctgcaaatgaattctctgcgtgcagaggatactgctatctattactgcgcgcgtacgggctggttgggcccgtttgattattggggccaaggcactttggttactgtgtcatcgggcgggggctctggcggtggttcaggtggtggcagtggtggtggcgagatcgtgttgactcaatctccgggtactctgtctctgtctccgggtgaacgcgcgaccctgtcttgccgcgcttctcagagtgttggttcatcgtatctggcatggtatcaacagaaaccgggtcaagcgccgcgtctgctgatttacggtgcttttagtcgcgcaaccgggattccggatcgattttctggttcaggttctggcactgactttactttgactattagtcgtctggaaccggaggacttcgcggtttattattgccaacagtatggttcttctccgtggacctttggtcaaggcactaaagttgaaattaaataatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 767 - protein, 242 aa, Artificial Sequence
  Description of Artificial Sequence: Synthetic polypeptide
  anti CTLA-4 scFv; Light Chain  linker  Heavy Chain Transcribed from the native FliC promoter and 5UTR (untranslated region) with an optimized ribosome binding site
MEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 768 - DNA, 1103 bp, Artificial Sequence
  Description of Artificial Sequence: Synthetic polynucleotide
  anti CTLA-4 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacagattataaggagttaaatagaaaaatggagattgtactgacccagagccctggtacattgtctttgtcgcctggtgaacgcgcgactctgtcttgtcgtgcgtctcagtctgttggtagttcgtatctggcgtggtatcaacaaaaaccgggccaagctccgcgtctgctgatttacggtgcatttagccgcgcgactggcattccggaccgcttttctgggtctggctcaggtaccgattttactctgactatttcgcgtctggagccggaggatttcgcggtttattactgccagcaatatggttctagtccgtggaccttcggccaaggtactaaagtggaaatcaaaggcgggggttcgggtggtggctctgggggtggctcgggcggtgggcaggtgcaactggttgagagtggtggcggcgttgttcaaccgggccgctctctgcgcctgtcgtgcgctgcttctggctttacctttagctcttatacgatgcactgggttcgccaagctccgggtaaaggtctggagtgggtgactttcatttcttacgatggtaacaacaaatattatgctgattctgttaaaggccgttttactatttctcgagacaatagcaaaaacactctgtacctgcagatgaattctctgcgcgctgaagacaccgcgatttattattgtgcgcgcactggttggctgggtccgtttgattattggggtcagggcacgctggttactgttagctcgtgatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 769 - protein, 236 aa, Artificial Sequence
  Description of Artificial Sequence: Synthetic polypeptide
  anti PD-1 scFv; Heavy Chain  linker  Light Chain Transcribed from the native FliC promoter and 5UTR (untranslated region) with an optimized ribosome binding site
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 770 - DNA, 1095 bp, Artificial Sequence
  Description of Artificial Sequence: Synthetic polynucleotide
  anti PD-1 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacctcaaagaattataggaaaggaggaagcgataagtatgcaggtgcaattggtggagtcgggtggcggcgtggtgcaaccgggtcgtagcctgcgcctggattgtaaagcgtcaggcatcacgtttagcaattctggcatgcactgggtgcgtcaagcgccgggcaaaggtctggagtgggttgcggtaatttggtacgatggttctaaacgctattacgcggatagtgtgaaaggtcgctttactatctctcgcgataattctaaaaacaccctgtttctgcaaatgaattcgttgcgtgcggaagatactgcggtatattattgtgctactaacgatgattattggggtcaaggcaccctggtgactgtttcgagcggcggtggtagcggcggcggctctggtggtggttctggtggcggtgagattgtgctgactcaaagcccggcgaccctgtctctgtcgccgggtgaacgcgctactctgagttgccgtgcgtcgcaaagcgtgtcttcttatctggcgtggtaccaacaaaaaccgggtcaagcgccgcgcctgctgatatatgatgctagtaatcgtgcaacgggtattccggcacgcttttcaggttctggcagcggcaccgatttcactctgactatctcgtcactggagccggaagactttgcggtttattattgtcagcaatcttctaattggccgcgtacgtttggtcagggcactaaagttgaaatcaaataatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 771 - protein, 236 aa, Artificial Sequence
  Description of Artificial Sequence: Synthetic polypeptide
  anti PD-1 scFv; Light Chain  linker  Heavy Chain Transcribed from the native FliC promoter and 5UTR (untranslated region) with an optimized ribosome binding site
MEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 772 - DNA, 1085 bp, Artificial Sequence
  Description of Artificial Sequence: Synthetic polynucleotide
  anti PD-1 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaacatcaccaatttgaggaaaggtaaatatggaaatcgttttaacgcagtcgccggcgactctgtctttgtcgcctggtgaacgtgctacgctgtcttgccgcgcgtcacagtctgtgtcgtcatatctggcttggtaccaacagaaaccgggccaagctccgcgcctgctgatttatgatgcgtctaatcgcgcgaccggcattccggcgcgtttttctggctccggctctggcaccgactttactctgactatttcgtctctggaaccggaagattttgcggtgtactattgccagcaatcttctaattggccgcgcacgtttggtcaaggtaccaaggttgagatcaaaggtggtggctcgggcggcggttcgggcggcggctcaggtggtggccaagttcagttggttgagtctggcgggggcgtagtacaaccgggtcgttctttgcgtctggattgcaaagcgagcggtattacctttagcaattcaggtatgcactgggtgcgccaagcgccgggcaaaggcctggaatgggttgcggtgatttggtacgatggctcgaaacgttattatgctgacagcgttaaaggtcgttttactattagccgtgataattccaaaaatacgctgtttctgcagatgaatagcctgcgtgctgaagacactgcggtttattactgtgctactaatgatgattactggggccagggcaccctggtgactgtgagttcttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 773 - protein, 242 aa, Artificial Sequence
  Description of Artificial Sequence: Synthetic polypeptide
  anti PDL-1 scFv; Heavy Chain  linker  Light Chain Transcribed from the native FliC promoter and 5UTR (untranslated region) with an optimized ribosome binding site
MEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGSGGGSGGGSGGGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 774 - DNA, 1103 bp, Artificial Sequence
  Description of Artificial Sequence: Synthetic polynucleotide
  anti PDL-1 scFv; Codon-optimized Heavy Chain  linker Light Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaactacataattttggggagggtactcgatggaagttcagctggtggagagtggtggcggtctggtgcagccgggcggctctctgcgtctgagctgtgcggcgtctggctttacgttttctgacagttggattcactgggtgcgccaagcaccgggcaaaggcctggagtgggtggcgtggatttctccgtatggcggtagtacttattatgctgattctgtgaaaggccgttttaccatttcggcggacacttcaaaaaataccgcgtatctgcaaatgaatagcctgcgcgctgaagacacggctgtttactactgtgctcgccgccactggccgggcggtttcgattattggggccaaggcactctggtgactgtgagctctggcggcgggtcgggtggcggttctggcggtggcagtggcggtggtgatattcaaatgacccaatctccgtcgtctctgagcgcgtctgtgggcgatcgtgtaaccattacttgtcgtgcgtcgcaggatgtgtctactgctgtggcgtggtatcagcaaaaaccgggtaaagctccgaaactgctgatttatagcgcttcttttctgtatagtggtgttccgtcacgttttagcggttcaggctctggtactgatttcacactgactatttcttctctgcaaccggaagatttcgcgacttattattgtcagcagtacttgtaccacccggcaacttttggtcagggcactaaagttgaaattaaacgttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 775 - protein, 242 aa, Artificial Sequence
  Description of Artificial Sequence: Synthetic polypeptide
  anti PDL-1 scFv; Light Chain  linker  Heavy Chain Transcribed from the native FliC promoter and 5UTR (untranslated region) with an optimized ribosome binding site
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSS

SEQ ID NO: 776 - DNA, 1103 bp, Artificial Sequence
  Description of Artificial Sequence: Synthetic polynucleotide
  anti PDL-1 scFv; Codon-optimized Light Chain  linker Heavy Chain Transcribed from the native FliC promoter and 5UTR (untranslated region) with an optimized ribosome binding site
agcgggaataaggggcagagaaaagagtatttcgtcgactaacaaaaaatggctgtttgtgaaaaaaattctaaaggttgttttacgacagacgataacagggttgacggcgattgagccgacgggtggaaacccaaaacgtaatcaactggcagacgcctaaggaggaagaccatggatattcagatgactcagagccctagctcactgtctgcgtcagttggcgatcgtgtgactattacctgtcgcgctagtcaggatgtgtctacggcggttgcgtggtatcaacagaaaccgggcaaagctccgaaactgttgatttattcagcgtctttcctgtattcgggtgtgccttctcgcttttcgggctctggtagcggtactgattttacgctgactattagttcactgcaaccggaggactttgcgacttattattgccaacaatacctgtatcacccggcgacctttggtcaaggcactaaagtggaaattaaacgcggcggcggcagcggtggcggctctggtggtgggtctggtggtggtgaggttcagctggttgagtctggtggtggtctggttcaacctgggggcagcctgcgcctgtcgtgcgcggcgtctggttttacgttctcagattcttggattcactgggtacgtcaagctccgggcaaaggtctggagtgggtggcgtggatttctccgtatggcggttcgacgtattacgcggactctgttaaagggcgttttacgatctcagcggatacttctaaaaatactgcgtatctgcaaatgaattctctgcgagcggaggataccgcggtgtattactgtgctcgccgccactggcctggtggtttcgattattggggtcaaggtaccctggtgactgtttcgtcttaatcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 777 - protein, 606 aa, Artificial Sequence
  Description of Artificial Sequence: Synthetic polypeptide
  anti CTLA-4 scFv
MNKVYSLKYCPVTGGLIVVSELASRVIKKTCRRLTHILLAGIPAVYLYYPQISQAGIVRQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 778 - DNA, 2038 bp, Artificial Sequence
  Description of Artificial Sequence: Synthetic polynucleotide
  anti CTLA-4 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 779 - protein, 606 aa, Artificial Sequence
  Description of Artificial Sequence: Synthetic polypeptide
  anti CTLA-4 scFv
MNKVYSLKYCPVTGGLIVVSELASRVIKKTCRRLTHILLAGIPAVYLYYPQISQAGIVREIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 780 - DNA, 2038 bp, Artificial Sequence
  Description of Artificial Sequence: Synthetic polynucleotide
  anti CTLA-4 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 781 - protein, 600 aa, Artificial Sequence
  Description of Artificial Sequence: Synthetic polypeptide
  anti PD-1 scFv
MNKVYSLKYCPVTGGLIVVSELASRVIKKTCRRLTHILLAGIPAVYLYYPQISQAGIVRQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 782 - DNA, 2020 bp, Artificial Sequence
  Description of Artificial Sequence: Synthetic polynucleotide
  anti PD-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 783 - protein, 600 aa, Artificial Sequence
  Description of Artificial Sequence: Synthetic polypeptide
  anti PD-1 scFv
MNKVYSLKYCPVTGGLIVVSELASRVIKKTCRRLTHILLAGIPAVYLYYPQISQAGIVREIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 784 - DNA, 2020 bp, Artificial Sequence
  Description of Artificial Sequence: Synthetic polynucleotide
  anti PD-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 785 - protein, 606 aa, Artificial Sequence
  Description of Artificial Sequence: Synthetic polypeptide
  anti PDL-1 scFv
MNKVYSLKYCPVTGGLIVVSELASRVIKKTCRRLTHILLAGIPAVYLYYPQISQAGIVRDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 786 - DNA, 2038 bp, Artificial Sequence
  Description of Artificial Sequence: Synthetic polynucleotide
  anti PDL-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 787 - protein, 600 aa, Artificial Sequence; identical to SEQ ID NO: 783
  Description of Artificial Sequence: Synthetic polypeptide
  anti PDL-1 scFv

SEQ ID NO: 788 - DNA, 2038 bp, Artificial Sequence
  Description of Artificial Sequence: Synthetic polynucleotide
  anti PDL-1 scFv
atctaatctagacatcattaattcctaatttttgttgacactctatcattgatagagttattttaccactccctatcagtgatagagaaaagtgaattaaatatcaactagaggtcaccaaatgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaactctaacggacttgagtgaggttgtaaagggagttggctcctcggtaccaaattccagaaaagaggcctcccgaaaggggggccttttttcgtttt

SEQ ID NO: 789 - protein, 294 aa, Artificial Sequence
  Description of Artificial Sequence: Synthetic polypeptide
  anti CTLA-4 scFv
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGSGGGSGGGSGGGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKLNPLINEISKIISAAGNFDVKEERAAASLLQLSGNASDFSYGRNSITLTASA

SEQ ID NO: 790 - DNA, 5309 bp, Artificial Sequence
  Description of Artificial Sequence: Synthetic polynucleotide
  anti CTLA-4 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatacgatttaattcggaggttttttgatgcaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 791 - protein, 294 aa, Artificial Sequence
  Description of Artificial Sequence: Synthetic polypeptide
  anti CTLA-4 scFv
MEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGSGGGSGGGSGGGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSLNPLINEISKIISAAGNFDVKEERAAASLLQLSGNASDFSYGRNSITLTASA

SEQ ID NO: 792 - DNA, 5309 bp, Artificial Sequence
  Description of Artificial Sequence: Synthetic polynucleotide
  anti CTLA-4 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatcacaacgctgagagagagagaaatatggaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 793 - protein, 288 aa, Artificial Sequence
  Description of Artificial Sequence: Synthetic polypeptide
  anti PD-1 scFv
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGSGGGSGGGSGGGEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKLNPLINEISKIISAAGNFDVKEERAAASLLQLSGNASDFSYGRNSITLTASA

SEQ ID NO: 794 - DNA, 5291 bp, Artificial Sequence
  Description of Artificial Sequence: Synthetic polynucleotide
  anti PD-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaagttaaattgaggaggaggcagttccatgcaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 795 - protein, 288 aa, Artificial Sequence
  Description of Artificial Sequence: Synthetic polypeptide
  anti PD-1 scFv
MEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGSGGGSGGGSGGGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSLNPLINEISKIISAAGNFDVKEERAAASLLQLSGNASDFSYGRNSITLTASA

SEQ ID NO: 796 - DNA, 5291 bp, Artificial Sequence
  Description of Artificial Sequence: Synthetic polynucleotide
  anti PD-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaatataccgaacgcttaaggaggctttatggaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 797 - protein, 294 aa, Artificial Sequence
  Description of Artificial Sequence: Synthetic polypeptide
  anti PDL-1 scFv
MEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGSGGGSGGGSGGGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRLNPLINEISKIISAAGNFDVKEERAAASLLQLSGNASDFSYGRNSITLTASA

SEQ ID NO: 798 - DNA, 5309 bp, Artificial Sequence
  Description of Artificial Sequence: Synthetic polynucleotide
  anti PDL-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaagatagggaccaggtaaggaggatgaatggaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 799 - protein, 294 aa, Artificial Sequence
  Description of Artificial Sequence: Synthetic polypeptide
  anti PDL-1 scFv
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGSGGGSGGGSGGGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSLNPLINEISKIISAAGNFDVKEERAAASLLQLSGNASDFSYGRNSITLTASA

SEQ ID NO: 800 - DNA, 5309 bp, Artificial Sequence
  Description of Artificial Sequence: Synthetic polynucleotide
  anti PDL-1 scFv
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaaaagtgaaataaatcccttcatgaggaggtaagatggatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataatttattaatttaaataatagcaatcttactgggctgtgccacataagattgctatttttttggagtcataatggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaacagaaagaacagaagaatatgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaagtctcagagccgcggtatccggctcatatcttctcctg

SEQ ID NO: 801 - DNA, 104 bp, Artificial Sequence
  Description of Artificial Sequence: Synthetic polynucleotide
  fliC promoter
agcgggaataaggggcagagaaaagagtatttcgtcgactaacaaaaaatggctgtttgtgaaaaaaattctaaaggttgttttacgacagacgataacagggt

SEQ ID NO: 802 - DNA, 45 bp, Artificial Sequence
  Description of Artificial Sequence: Synthetic oligonucleotide
  fliC 5 untranslated region
tgacggcgattgagccgacgggtggaaacccaaaacgtaatcaac

SEQ ID NO: 803 - DNA, 96 bp, Artificial Sequence
  Description of Artificial Sequence: Synthetic oligonucleotide
  Tetracycline responsive promoter
atctaatctagacatcattaattcctaatttttgttgacactctatcattgatagagttattttaccactccctatcagtgatagagaaaagtgaa

SEQ ID NO: 804 - DNA, 705 bp, Artificial Sequence
  Description of Artificial Sequence: Synthetic polynucleotide
  Tetracycline responsive promoter
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcatttatagagttaatttaccactccctatcagtgatagagaa

SEQ ID NO: 805 - DNA, 25 bp, Artificial Sequence
  Description of Artificial Sequence: Synthetic oligonucleotide
  Optimized ribosome binding site
aaataaaaatgaggaggcaattcta

SEQ ID NO: 806 - DNA, 25 bp, Artificial Sequence
  Description of Artificial Sequence: Synthetic oligonucleotide
  Optimized ribosome binding site
agattataaggagttaaatagaaaa

SEQ ID NO: 807 - DNA, 35 bp, Artificial Sequence
  Description of Artificial Sequence: Synthetic oligonucleotide
  Optimized ribosome binding site
ctcaaagaattataggaaaggaggaagcgataagt

SEQ ID NO: 808 - DNA, 25 bp, Artificial Sequence
  Description of Artificial Sequence: Synthetic oligonucleotide
  Optimized ribosome binding site
atcaccaatttgaggaaaggtaaat

SEQ ID NO: 809 - DNA, 25 bp, Artificial Sequence
  Description of Artificial Sequence: Synthetic oligonucleotide
  Optimized ribosome binding site
tggcagacgcctaaggaggaagacc

SEQ ID NO: 810 - DNA, 25 bp, Artificial Sequence
  Description of Artificial Sequence: Synthetic oligonucleotide
  Optimized ribosome binding site
tacataattttggggagggtactcg

SEQ ID NO: 811 - DNA, 25 bp, Artificial Sequence
  Description of Artificial Sequence: Synthetic oligonucleotide
  Optimized ribosome binding site
ttaaatatcaactagaggtcaccaa

SEQ ID NO: 812 - DNA, 25 bp, Artificial Sequence
  Description of Artificial Sequence: Synthetic oligonucleotide
  Optimized ribosome binding site
tacgatttaattcggaggttttttg

SEQ ID NO: 813 - DNA, 25 bp, Artificial Sequence
  Description of Artificial Sequence: Synthetic oligonucleotide
  Optimized ribosome binding site
tcacaacgctgagagagagagaaat

SEQ ID NO: 814 - DNA, 25 bp, Artificial Sequence
  Description of Artificial Sequence: Synthetic oligonucleotide
  Optimized ribosome binding site
gttaaattgaggaggaggcagttcc

SEQ ID NO: 815 - DNA, 25 bp, Artificial Sequence
  Description of Artificial Sequence: Synthetic oligonucleotide
  Optimized ribosome binding site
tataccgaacgcttaaggaggcttt

SEQ ID NO: 816 - DNA, 25 bp, Artificial Sequence
  Description of Artificial Sequence: Synthetic oligonucleotide
  Optimized ribosome binding site
ataaatcccttcatgaggaggtaag

SEQ ID NO: 817 - DNA, 25 bp, Artificial Sequence
  Description of Artificial Sequence: Synthetic oligonucleotide
  Optimized ribosome binding site
gatagggaccaggtaaggaggatga

SEQ ID NO: 818 - DNA, 200 bp, Artificial Sequence
  Description of Artificial Sequence: Synthetic polynucleotide
  Terminator sequence
tcgccgtaacctgattaactgagactgacggcaacgccaaattgcctgatgcgctgcgcttatcaggcctacaaggggaattgcaatttattgaatttgcacatttttgtaggccggataaggcgtttacgccgcatccggcaacatgaatggtaatttgccagcaacgtgcttccccgccaacggcggggttttttctg

SEQ ID NO: 819 - DNA, 96 bp, Artificial Sequence
  Description of Artificial Sequence: Synthetic oligonucleotide
  Terminator sequence
ctctaacggacttgagtgaggttgtaaagggagttggctcctcggtaccaaattccagaaaagaggcctcccgaaaggggggccttttttcgtttt

SEQ ID NO: 820 - DNA, 38 bp, Artificial Sequence
  Description of Artificial Sequence: Synthetic oligonucleotide
  Terminator sequence
gtctcagagccgcggtatccggctcatatcttctcctg

SEQ ID NO: 821 - DNA, 177 bp, Artificial Sequence
  Description of Artificial Sequence: Synthetic polynucleotide
  N terminal secretion tag for Type V auto-secreter secretion
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgc

SEQ ID NO: 822 - DNA, 921 bp, Artificial Sequence
  Description of Artificial Sequence: Synthetic polynucleotide
  C terminal secretion tag for Type V auto-secreter secretion
ttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 823 - DNA, 729 bp, Artificial Sequence
  Description of Artificial Sequence: Synthetic polynucleotide
  Anti-CTLA-4 single chain antibody coding region (Heavy Chain linker Light Chain)
atgcaagtgcaactggtagagtccggtgggggcgtggtgcagccgggtcgcagcctgcgtctgtcgtgcgcggcgagtggttttacgttttcgagttatactatgcactgggttcgtcaagcgccgggcaaaggcctggaatgggttactttcatttcttacgatggtaataataaatattatgcggattctgtgaaaggtcgctttactatttcgcgcgataacagtaaaaacactctgtatctgcaaatgaattctctgcgtgcagaggatactgctatctattactgcgcgcgtacgggctggttgggcccgtttgattattggggccaaggcactttggttactgtgtcatcgggcgggggctctggcggtggttcaggtggtggcagtggtggtggcgagatcgtgttgactcaatctccgggtactctgtctctgtctccgggtgaacgcgcgaccctgtcttgccgcgcttctcagagtgttggttcatcgtatctggcatggtatcaacagaaaccgggtcaagcgccgcgtctgctgatttacggtgcttttagtcgcgcaaccgggattccggatcgattttctggttcaggttctggcactgactttactttgactattagtcgtctggaaccggaggacttcgcggtttattattgccaacagtatggttcttctccgtggacctttggtcaaggcactaaagttgaaattaaataa

SEQ ID NO: 824 - DNA, 729 bp, Artificial Sequence
  Description of Artificial Sequence: Synthetic polynucleotide
  Anti-CTLA-4 single chain antibody coding region (Light Chain linker Heavy Chain)
atggagattgtactgacccagagccctggtacattgtctttgtcgcctggtgaacgcgcgactctgtcttgtcgtgcgtctcagtctgttggtagttcgtatctggcgtggtatcaacaaaaaccgggccaagctccgcgtctgctgatttacggtgcatttagccgcgcgactggcattccggaccgcttttctgggtctggctcaggtaccgattttactctgactatttcgcgtctggagccggaggatttcgcggtttattactgccagcaatatggttctagtccgtggaccttcggccaaggtactaaagtggaaatcaaaggcgggggttcgggtggtggctctgggggtggctcgggcggtgggcaggtgcaactggttgagagtggtggcggcgttgttcaaccgggccgctctctgcgcctgtcgtgcgctgcttctggctttacctttagctcttatacgatgcactgggttcgccaagctccgggtaaaggtctggagtgggtgactttcatttcttacgatggtaacaacaaatattatgctgattctgttaaaggccgttttactatttctcgagacaatagcaaaaacactctgtacctgcagatgaattctctgcgcgctgaagacaccgcgatttattattgtgcgcgcactggttggctgggtccgtttgattattggggtcagggcacgctggttactgttagctcgtga

SEQ ID NO: 825 - DNA, 711 bp, Artificial Sequence
  Description of Artificial Sequence: Synthetic polynucleotide
  Anti-PD-1 single chain antibody coding region (Heavy Chain linker Light Chain)
atgcaggtgcaattggtggagtcgggtggcggcgtggtgcaaccgggtcgtagcctgcgcctggattgtaaagcgtcaggcatcacgtttagcaattctggcatgcactgggtgcgtcaagcgccgggcaaaggtctggagtgggttgcggtaatttggtacgatggttctaaacgctattacgcggatagtgtgaaaggtcgctttactatctctcgcgataattctaaaaacaccctgtttctgcaaatgaattcgttgcgtgcggaagatactgcggtatattattgtgctactaacgatgattattggggtcaaggcaccctggtgactgtttcgagcggcggtggtagcggcggcggctctggtggtggttctggtggcggtgagattgtgctgactcaaagcccggcgaccctgtctctgtcgccgggtgaacgcgctactctgagttgccgtgcgtcgcaaagcgtgtcttcttatctggcgtggtaccaacaaaaaccgggtcaagcgccgcgcctgctgatatatgatgctagtaatcgtgcaacgggtattccggcacgcttttcaggttctggcagcggcaccgatttcactctgactatctcgtcactggagccggaagactttgcggtttattattgtcagcaatcttctaattggccgcgtacgtttggtcagggcactaaagttgaaatcaaataa

SEQ ID NO: 826 - DNA, 711 bp, Artificial Sequence
  Description of Artificial Sequence: Synthetic polynucleotide
  Anti-PD-1 single chain antibody coding region (Light Chain linker Heavy Chain)
atggaaatcgttttaacgcagtcgccggcgactctgtctttgtcgcctggtgaacgtgctacgctgtcttgccgcgcgtcacagtctgtgtcgtcatatctggcttggtaccaacagaaaccgggccaagctccgcgcctgctgatttatgatgcgtctaatcgcgcgaccggcattccggcgcgtttttctggctccggctctggcaccgactttactctgactatttcgtctctggaaccggaagattttgcggtgtactattgccagcaatcttctaattggccgcgcacgtttggtcaaggtaccaaggttgagatcaaaggtggtggctcgggcggcggttcgggcggcggctcaggtggtggccaagttcagttggttgagtctggcgggggcgtagtacaaccgggtcgttctttgcgtctggattgcaaagcgagcggtattacctttagcaattcaggtatgcactgggtgcgccaagcgccgggcaaaggcctggaatgggttgcggtgatttggtacgatggctcgaaacgttattatgctgacagcgttaaaggtcgttttactattagccgtgataattccaaaaatacgctgtttctgcagatgaatagcctgcgtgctgaagacactgcggtttattactgtgctactaatgatgattactggggccagggcaccctggtgactgtgagttcttaa

SEQ ID NO: 827 - DNA, 729 bp, Artificial Sequence
  Description of Artificial Sequence: Synthetic polynucleotide
  Anti-PD-L1 single chain antibody coding region (Light Chain linker Heavy Chain)
atggatattcagatgactcagagccctagctcactgtctgcgtcagttggcgatcgtgtgactattacctgtcgcgctagtcaggatgtgtctacggcggttgcgtggtatcaacagaaaccgggcaaagctccgaaactgttgatttattcagcgtctttcctgtattcgggtgtgccttctcgcttttcgggctctggtagcggtactgattttacgctgactattagttcactgcaaccggaggactttgcgacttattattgccaacaatacctgtatcacccggcgacctttggtcaaggcactaaagtggaaattaaacgcggcggcggcagcggtggcggctctggtggtgggtctggtggtggtgaggttcagctggttgagtctggtggtggtctggttcaacctgggggcagcctgcgcctgtcgtgcgcggcgtctggttttacgttctcagattcttggattcactgggtacgtcaagctccgggcaaaggtctggagtgggtggcgtggatttctccgtatggcggttcgacgtattacgcggactctgttaaagggcgttttacgatctcagcggatacttctaaaaatactgcgtatctgcaaatgaattctctgcgagcggaggataccgcggtgtattactgtgctcgccgccactggcctggtggtttcgattattggggtcaaggtaccctggtgactgtttcgtcttaa

SEQ ID NO: 828 - DNA, 729 bp, Artificial Sequence
  Description of Artificial Sequence: Synthetic polynucleotide
  Anti-PD-L1 single chain antibody coding region (Heavy Chain linker Light Chain)
atggaagttcagctggtggagagtggtggcggtctggtgcagccgggcggctctctgcgtctgagctgtgcggcgtctggctttacgttttctgacagttggattcactgggtgcgccaagcaccgggcaaaggcctggagtgggtggcgtggatttctccgtatggcggtagtacttattatgctgattctgtgaaaggccgttttaccatttcggcggacacttcaaaaaataccgcgtatctgcaaatgaatagcctgcgcgctgaagacacggctgtttactactgtgctcgccgccactggccgggcggtttcgattattggggccaaggcactctggtgactgtgagctctggcggcgggtcgggtggcggttctggcggtggcagtggcggtggtgatattcaaatgacccaatctccgtcgtctctgagcgcgtctgtgggcgatcgtgtaaccattacttgtcgtgcgtcgcaggatgtgtctactgctgtggcgtggtatcagcaaaaaccgggtaaagctccgaaactgctgatttatagcgcttcttttctgtatagtggtgttccgtcacgttttagcggttcaggctctggtactgatttcacactgactatttcttctctgcaaccggaagatttcgcgacttattattgtcagcagtacttgtaccacccggcaacttttggtcagggcactaaagttgaaattaaacgttaa

SEQ ID NO: 829 - DNA, 1821 bp, Artificial Sequence
  Description of Artificial Sequence: Synthetic polynucleotide
  Anti-CTLA-4 single chain antibody coding region (Heavy Chain linker Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 830 - DNA, 1821 bp, Artificial Sequence
  Description of Artificial Sequence: Synthetic polynucleotide
  Anti-CTLA-4 single chain antibody coding region (Light Chain linker Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 831 - DNA, 1803 bp, Artificial Sequence
  Description of Artificial Sequence: Synthetic polynucleotide
  Anti-PD-1 single chain antibody coding region (Heavy Chain linker  Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgccaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaattcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 832 - DNA, 1803 bp, Artificial Sequence
  Description of Artificial Sequence: Synthetic polynucleotide
  Anti-PD-1 single chain antibody coding region (Light Chain linker Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 833 - DNA, 1821 bp, Artificial Sequence
  Description of Artificial Sequence: Synthetic polynucleotide
  Anti-PD-L1 single chain antibody coding region (Light Chain linker Heavy Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 834 - DNA, 1821 bp, Artificial Sequence
  Description of Artificial Sequence: Synthetic polynucleotide
  Anti-PD-L1 single chain antibody coding region (Heavy Chain linker Light Chain) with N terminal and C terminal Secretion Tag for Type V auto-secreter
atgaacaaagtatatagcctgaaatattgcccagtaactgggggtctgattgtagtcagtgaactggcatcccgcgtcatcaaaaaaacctgccgtcgtctgactcacatcctgctggcgggtattccggctgtgtatctgtactacccgcagatctcccaggcaggtatcgtccgcgaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgcttcaaagcggaggctgacaaggccgctgcagcaaaagctgactcctttatgaacgcgggttacaaaaacttcatgaccgaggtaaataatctcaataaacgtatgggtgatctgcgcgacactaatggggatgcaggcgcatgggcacgcattatgtctggtgcaggttcggcggatggcgggtattctgacaattacactcatgttcaggtgggcttcgataaaaaacatgagctggacggtgtggatctgttcactggcgtaaccatgacttatactgattcaagcgcagacagccacgcattttcaggtaaaacgaaatcagttggcggcggtctgtatgcgagcgcactgttcgagagcggcgcctacattgatctaattggcaagtatattcaccatgataatgattacacagggaactttgcaggcctgggcaccaaacactataacacgcattcatggtacgctggcgcagaaaccggctatagataccacctgaccgaggaaacctttatcgaaccgcaagcggaactggtttacggtgcggtcagtggcaagacctttcgttggaaagatggtgatatggatctgtcaatgaaaaaccgcgacttcagccccttgatcggccgcaccggcattgagctgggcaaaaccttctctggcaaagattggtctgttaccgcgcgtgcgggcacttcgtggcaatttgatctgctaaacaacggtgagactgtactgcgtgatgcgagtggcgaaaaacgtattaaaggtgaaaaagatagtagaatgctattcaacgtgggcatgaatgcgcagatcaaagataacatgcgttttgggttggagtttgaaaaatccgcgttcggtaaatataatgttgacaatgctgtgaacgcgaatttccgctacatgttttaa

SEQ ID NO: 835 - DNA, 885 bp, Artificial Sequence
  Description of Artificial Sequence: Synthetic polynucleotide
  Anti-CTLA-4 single chain antibody coding region (Heavy Chain linker Light Chain) for type I hemolysin secretion, including HlyA tag
atgcaggtacaattagttgagagcggcggcggtgtggttcaaccgggccgtagtctgcgattgtcttgtgctgcatctggttttactttcagttcttacacgatgcactgggttcgccaagctccgggcaaaggcctggagtgggttacctttatttcttacgatggcaataataagtattacgctgattctgtgaaaggtcgctttactattagccgagataactctaaaaatactctgtatctgcaaatgaattctctgcgtgcggaagatactgcgatctattattgtgcgcgtactggttggctgggcccgtttgattattggggccaaggcacgctggttactgttagttcgggcggcggttctggtggcggctctggtggtggctctggcggcggcgagattgtgctgactcaatctccgggcacgctgtcactgtctccgggtgaacgcgcgaccctgtcttgtcgcgcgagtcaaagtgttggttcttcttatctggcttggtatcagcaaaagcctggtcaagcgccgcgtctgttgatttatggcgcgttttcgcgcgcgactggcattccggaccgattttctggttctggttctggcactgatttcactctgaccatttcacgcctggaaccggaggattttgcggtgtactattgccaacaatatggctcatcgccgtggacgtttggccaaggtactaaagttgagattaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 836 - DNA, 885 bp, Artificial Sequence
  Description of Artificial Sequence: Synthetic polynucleotide
  Anti-CTLA-4 single chain antibody coding region (Light Chain linker Heavy Chain) for type I hemolysin secretion, including HlyA tag
atggaaattgtactgacccagtcgcctggtaccctgtctctgtcgccgggtgaacgtgctaccctgtcttgtcgtgcttcgcaatcggttggctcgtcttatctggcatggtatcagcaaaaaccgggccaagcgcctcgtctgctgatttatggcgcgttttctcgtgctacgggcattcctgatcgtttttcgggctctggctctggtactgattttacgctgactatcagccgcttggaacctgaagattttgcggtttattattgccaacaatatggctcttctccgtggacgtttggtcaaggcactaaagttgaaattaaaggtggtggctcgggcggtggttctggtggtggtagtggtggtggtcaagtgcagttggttgaatcgggtggcggtgttgtgcagccgggccgttcgttgcgtctgtcttgcgcagcgagtggtttcaccttctcttcttatactatgcactgggtgcgtcaagcacctggcaaaggtctggagtgggtaacttttatttcatacgatggtaataataaatattatgcagattctgttaaaggtcgctttacgatttctcgcgataattcaaaaaatacgctgtatctgcagatgaattcgctgcgcgctgaggatactgcgatctactattgtgcgcgtactggttggctgggtccgtttgattactggggccaaggtacgctggttacagtttcgtcgcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 837 - DNA, 867 bp, Artificial Sequence
  Description of Artificial Sequence: Synthetic polynucleotide
  Anti-PD-1 single chain antibody coding region (Heavy Chain linker Light Chain) for type I hemolysin secretion, including HlyA tag
atgcaagtacaactggttgaatccggcggaggagtggtgcaaccgggccgcagtttgcgtctggattgtaaagcttcaggcatcactttttctaattctggtatgcactgggttcgccaagctccgggtaaaggtctggagtgggttgcggtgatctggtatgatggttctaaacgatattatgcggatagtgttaagggtcgttttactatttctcgtgataattctaagaacaccttgtttctgcagatgaatagtctgcgcgctgaggatactgcggtatattattgtgcgactaatgacgattattggggccaaggcacgctggttaccgtgagctctggtggtggttcgggtggtggttctggtggtgggagcggcggtggcgagatcgttctgactcaaagcccggcgactctgagtctgagtccgggtgaacgtgcgactctgagctgccgtgcgtctcagagtgtgtcgagttatctggcgtggtaccaacaaaaaccgggccaggcgccgcgactgctgatttatgatgcttctaatcgtgcgactggtattccggcgcgctttagcggttctggctcaggcactgacttcactctgactatttcttcgctggaaccggaagattttgcggtgtactattgtcaacaatcatctaattggcctcgtacgttcggtcaaggtacaaaagtggagataaaacttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 838 - DNA, 867 bp, Artificial Sequence
  Description of Artificial Sequence: Synthetic polynucleotide
  Anti-PD-1 single chain antibody coding region (Light Chain linker Heavy Chain) for type I hemolysin secretion, including HlyA tag
atggaaatcgtgctgactcagagtccggcgactctgtctctgagtccgggcgaacgcgcgactctgtcttgccgtgcgtctcaatctgtgtcttcatacttggcttggtaccaacaaaaaccgggccaggcgccgcgactgttgatttatgatgcgtcgaatcgcgcgactggcattccggcgcgcttttcgggtagcggttctggtactgattttacgctgactatctcttctctggagcctgaagatttcgctgtttattactgccaacagtctagtaattggccgcgtactttcggccagggcactaaggtggaaattaaaggtggcggctcgggcggcggctcgggtggtggttctggtggtggccaagtgcaactggtggaaagtggcggcggggtggtgcaaccgggccgttctctgcgcctggattgtaaagcttcaggcattacttttagcaactctggtatgcactgggttcgccaagctccgggcaaaggcctggaatgggtggcggttatttggtacgatggctctaaacgttattacgctgacagtgttaaaggccgctttaccatttctcgtgataattctaaaaataccctgtttctgcaaatgaactcgctgcgcgcggaagatactgctgtttactattgtgcgactaatgatgattactggggtcaaggtaccctggttaccgtgtcttctcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 839 - DNA, 885 bp, Artificial Sequence
  Description of Artificial Sequence: Synthetic polynucleotide
  Anti-PD-L1 single chain antibody coding region (Light Chain linker Heavy Chain) for type I hemolysin secretion, including HlyA tag
atggatattcaaatgactcaatctccgagctctctgagtgcgtctgtgggtgatcgtgtgactattacttgtcgtgcgtctcaagatgtttcaactgcggttgcgtggtatcaacagaaaccgggcaaggcgcctaagctgctgatttattctgcttcgttcctgtacagcggtgtgccgtctcgtttctctggctctggttcgggtactgatttcactctgactatttcgagtctgcagccggaagattttgcgacttattattgtcaacaatatctgtatcaccctgcgacgtttggtcaaggcacgaaagttgaaattaaacgtggtggtggctctggtggtggcagcggtggtgggtcgggtggcggtgaagttcaactggttgagtcaggtggtggcctggtgcaaccgggcggctctctgcgcctgtcttgtgctgcgtcgggttttacgttctctgatagctggattcactgggtacgccaggcaccgggcaaaggtctggaatgggtagcttggatttcaccttatggtggctctacttattacgcggatagcgtgaaaggtcgctttactatttctgcggacactagcaaaaatactgcttacctgcaaatgaattcgctgcgtgctgaggatactgcagtgtattactgtgcgcgtcgtcattggcctggcggctttgattattggggtcaaggtactctggttactgttagcagccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 840 - DNA, 885 bp, Artificial Sequence
  Description of Artificial Sequence: Synthetic polynucleotide
  Anti-PD-L1 single chain antibody coding region (Heavy Chain linker Light Chain) for type I hemolysin secretion, including HlyA tag
atggaagtgcagctggtggagtcaggtggaggcttggtgcaaccgggcggttcactgcgtctgtcatgtgcggcgtctgggtttacttttagtgactcttggattcactgggtgcgccaggctccgggtaaaggcctggaatgggtagcttggattagtccttacggtggctcgacctattatgctgattcggtaaagggtcgctttactattagcgctgatacttctaaaaatactgcatacctgcagatgaatagcctgcgcgctgaggatactgctgtgtattattgcgcgcgtcgccactggccgggcggctttgattattggggccaaggtactctggttaccgtgtctagtggcggtggtagcggcggcggctcaggtggcggctcgggcggtggcgacattcagatgactcagtctccgtcttctttgtcggcgagcgtgggcgatcgtgttaccatcacgtgtcgcgcgagccaagatgtgtcgactgcggtggcttggtatcaacaaaaaccgggtaaagctccgaaactgctgatttatagtgcgtcttttttgtattctggtgttccgtctcgtttctctggctcaggtagcggtactgattttacgctgactatttcttcactgcaaccggaagattttgctacgtattattgtcaacaatatctgtatcacccggcgacgtttggtcagggtactaaggtggagataaaacgccttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagcataa

SEQ ID NO: 841 - DNA, 159 bp, Artificial Sequence; identical to SEQ ID NO: 754
  Description of Artificial Sequence: Synthetic polynucleotide
  C terminal HlyA secretion Tag

SEQ ID NO: 842 - DNA, 2124 bp, Artificial Sequence
  Description of Artificial Sequence: Synthetic polynucleotide
  HlyB coding sequence
atggattcttgtcataaaattgattatgggttatacgccctggagattttagcccaataccataacgtctctgttaacccggaagaaattaaacatagatttgacacagacgggactggtctgggattaacgtcatggttgcttgctgcgaaatctttagaactaaaggtaaaacaggtaaaaaaaacaattgaccgattaaactttatttctttgcccgcattagtctggagagaggatggacgtcattttattctgactaaagtcagtaaagaagcaaacagatatcttatttttgatctggagcaacgaaatccccgtgttctcgaacagtctgagtttgaggcgttatatcaggggcatattattcttattgcttcccgttcttctgttaccgggaaactggcaaaatttgactttacctggtttatccctgccattataaaatacagaaaaatatttattgaaacccttgttgtatctgtttttttacaattatttgcattaataaccccccttttttttcaggtggttatggacaaagtattagtacacagggggttttcaacccttaatgttattactgtcgcattatctgttgtggtggtgtttgagattatactcagcggtttaagaacttacatttttgcacatagtacaagtcggattgatgttgagttgggtgccaaactcttccggcatttactggcgctaccgatctcttattttgagagtcgtcgtgttggtgatactgttgccagggtaagagaattagaccagatccgtaattttctgacaggacaggcattaacatctgttctggacttattattttcattcatattttttgcggtaatgtggtattacagcccaaagcttactctggtgatcttattttcgctgccctgttatgctgcatggtctgtttttattagccccattttgcgacgtcgccttgatgataagttttcacggaatgcggataatcaatctttcctggtggaatcagtcacggcgattaacactataaaagctatggcagtctcacctcagatgacgaacatatgggacaaacaattggcaggatatgttgctgcaggctttaaagtgacagtattagccaccattggtcaacaaggaatacagttaatacaaaagactgttatgatcatcaacctgtggttgggagcacacctggttatttccggggatttaagtattggtcagttaattgcttttaatatgcttgctggtcagattgttgcaccggttattcgccttgcacaaatctggcaggatttccagcaggttggtatatcagttacccgccttggtgatgtgcttaactctccaactgaaagttatcatgggaaactggcattaccggaaattaatggtaatatcacttttcgtaatatccggtttcgctataagcctgactctccggttattttagataatatcaatctcagtattaagcagggggaggttattggtattgtcggacgttctggttcaggaaaaagcacattaactaaattaattcaacgtttttatattcctgaaaatggccaggtcttaattgatggacatgatcttgcgttggccgatcctaactggttacgtcgtcaggtgggggttgtgttgcaggacaatgtgctgcttaatcgcagtattattgataatatctcactggctaatcctggtatgtccgtcgaaaaagttatttatgcagcgaaattagcaggcgctcatgattttatttctgaattgcgtgaggggtataacaccattgtcggggaacagggggcaggattatccggaggtcaacgtcaacgcatcgcaattgcaagggcgctggtgaacaaccctaaaatacttatttttgatgaagcaaccagtgctctggattatgagtcggagcatatcatcatgcgcaatatgcacaaaatatgtaagggcagaacggttataatcattgctcatcgtctgtctacagtaaaaaatgcagaccgcattattgtcatggaaaaagggaaaattgttgaacagggtaaacataaggaactgctttctgaaccggaaagtttatacagttacttatatcagttacagtcagactaa

SEQ ID NO: 843 - DNA, 1437 bp, Artificial Sequence
  Description of Artificial Sequence: Synthetic polynucleotide
  HlyD coding sequence
atgaaaacatggttaatggggttcagcgagttcctgttgcgctataaacttgtctggagtgaaacatggaaaatccggaagcaattagatactccggtacgtgaaaaggacgaaaatgaattcttacccgctcatctggaattaattgaaacgccggtatccagacggccgcgtctggttgcttattttattatggggtttctggttattgctgtcattttatctgttttaggtcaggtggaaattgttgccactgcaaatgggaaattaacactaagtgggcgcagcaaagaaattaaacctattgaaaactcaatagttaaagaaattatcgtaaaagaaggagagtcagtccggaaaggggatgtgttattaaagcttacagcactgggagctgaagctgatacgttaaaaacacagtcatcactgttacagaccaggctggaacaaactcggtatcaaattctgagcaggtcaattgaattaaataaactacctgaactgaagcttcctgatgagccttattttcagaatgtatctgaagaggaagtactgcgtttaacttctttgataaaagaacagttttccacatggcaaaatcagaagtatcaaaaagaactgaatctggataagaaaagagcagagcgattaacaatacttgcccgtataaaccgttatgaaaatttatcgagagttgaaaaaagccgtctggatgatttcaggagtttattgcataaacaggcaattgcaaaacatgctgtacttgagcaggagaataaatatgtcgaggcagcaaatgaattacgggtttataaatcgcaactggagcaaattgagagtgagatattgtctgcaaaagaagaatatcagcttgtcacgcagctttttaaaaatgaaattttagacaagctaagacaaacaacagacaacattgagttattaactctggagttagagaaaaatgaagagcgtcaacaggcttcagtaatcagggcccctgtttcgggaaaagttcagcaactgaaggttcatactgaaggtggggttgttacaacagcggaaacactgatggtcatcgttccggaagatgacacgctggaggttactgctctggtacaaaataaagatattggttttattaacgtcgggcagaatgccatcattaaagtggaggcctttccttacacccgatatggttatctggtgggtaaggtgaaaaatataaatttagatgcaatagaagaccagaaactgggactcgtttttaatgtcattgtttctgttgaagagaatgatttgtcaaccgggaataagcacattccattaagctcgggtatggctgtcactgcagaaataaagactggaatgcgaagcgtaatcagctatcttcttagtcctctggaagagtctgtaacagaaagtttacatgagcgttaa

SEQ ID NO: 844 - protein, 119 aa, Artificial Sequence
  Description of Artificial Sequence: Synthetic polypeptide
  Anti-CTLA-4 Heavy
MQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 845 - protein, 108 aa, Artificial Sequence; identical to SEQ ID NO: 8
  Description of Artificial Sequence: Synthetic polypeptide
  Anti-CTLA-4 Light

SEQ ID NO: 846 - protein, 114 aa, Artificial Sequence
  Description of Artificial Sequence: Synthetic polypeptide
  Anti-PD-1 Heavy
MQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 847 - protein, 107 aa, Artificial Sequence [sequence omitted]

SEQ ID NO: 848 - protein, 109 aa, Artificial Sequence
  Description of Artificial Sequence: Synthetic polypeptide
  Anti-PD-L1 Light
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 849 - protein, 118 aa, Artificial Sequence [sequence omitted]

SEQ ID NO: 850 - protein, 15 aa, Artificial Sequence
  Description of Artificial Sequence: Synthetic peptide
  Linker
GGGSGGGSGGGSGGG

SEQ ID NO: 851 - protein, 59 aa, Artificial Sequence
  Description of Artificial Sequence: Synthetic polypeptide
  N Terminal Secretion Tag For Type V Auto-secreter Secretion
MNKVYSLKYCPVTGGLIVVSELASRVIKKTCRRLTHILLAGIPAVYLYYPQISQAGIVR

SEQ ID NO: 852 - protein, 162 aa, Artificial Sequence
  Description of Artificial Sequence: Synthetic polypeptide
  C Terminal Secretion Tag For Type V Auto-secreter Secretion
FKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETG

SEQ ID NO: 853 - protein, 52 aa, Artificial Sequence; identical to SEQ ID NO: 753
  Description of Artificial Sequence: Synthetic polypeptide
  C-Terminal HlyA Secretion Tag

SEQ ID NO: 854 - protein, 707 aa, Artificial Sequence
  Description of Artificial Sequence: Synthetic polypeptide
  HlyB
MDSCHKIDYGLYALEILAQYHNVSVNPEEIKHRFDTDGTGLGLTSWLLAAKSLELKVKQVKKTIDRLNFISLPALVWREDGRHFILTKVSKEANRYLIFDLEQRNPRVLEQSEFEALYQGHIILIASRSSVTGKLAKFDFTWFIPAIIKYRKIFIETLVVSVFLQLFALITPLFFQVVMDKVLVHRGFSTLNVITVALSVVVVFEIILSGLRTYIFAHSTSRIDVELGAKLFRHLLALPISYFESRRVGDTVARVRELDQIRNFLTGQALTSVLDLLFSFIFFAVMWYYSPKLTLVILFSLPCYAAWSVFISPILRRRLDDKFSRNADNQSFLVESVTAINTIKAMAVSPQMTNIWDKQLAGYVAAGFKVTVLATIGQQGIQLIQKTVMIINLWLGAHLVISGDLSIGQLIAFNMLAGQIVAPVIRLAQIWQDFQQVGISVTRLGDVLNSPTESYHGKLALPEINGNITFRNIRFRYKPDSPVILDNINLSIKQGEVIGIVGRSGSGKSTLTKLIQRFYIPENGQVLIDGHDLALADPNWLRRQVGVVLQDNVLLNRSIIDNISLANPGMSVEKVIYAAKLAGAHDFISELREGYNTIVGEQGAGLSGGQRQRIAIARALVNNPKILIFDEATSALDYESEHIIMRNMHKICKGRTVIIIAHRLSTVKNADRIIVMEKGKIVEQGKHKELLSEPESLYSYLYQLQSD

SEQ ID NO: 855 - protein, 478 aa, Artificial Sequence
  Description of Artificial Sequence: Synthetic polypeptide
  HlyD
MKTWLMGFSEFLLRYKLVWSETWKIRKQLDTPVREKDENEFLPAHLELIETPVSRRPRLVAYFIMGFLVIAVILSVLGQVEIVATANGKLTLSGRSKEIKPIENSIVKEIIVKEGESVRKGDVLLKLTALGAEADTLKTQSSLLQTRLEQTRYQILSRSIELNKLPELKLPDEPYFQNVSEEEVLRLTSLIKEQFSTWQNQKYQKELNLDKKRAERLTILARINRYENLSRVEKSRLDDFRSLLHKQAIAKHAVLEQENKYVEAANELRVYKSQLEQIESEILSAKEEYQLVTQLFKNEILDKLRQTTDNIELLTLELEKNEERQQASVIRAPVSGKVQQLKVHTEGGVVTTAETLMVIVPEDDTLEVTALVQNKDIGFINVGQNAIIKVEAFPYTRYGYLVGKVKNINLDAIEDQKLGLVFNVIVSVEENDLSTGNKHIPLSSGMAVTAEIKTGMRSVISYLLSPLEESVTESLHER

SEQ ID NO: 856 - DNA, 213 bp, Artificial Sequence
  Description of Artificial Sequence: Synthetic polynucleotide
  PfnrS
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacat

SEQ ID NO: 857 - DNA, 1455 bp, Artificial Sequence
  Description of Artificial Sequence: Synthetic polynucleotide
  PfnrS-nupC
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatgtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggttttgccaacgaagggactaacttcgtctttggtagcatgaatgatcaaggcctggcattcttcttcctgaaagtgctgtgcccaatcgtctttatctctgcgctgatcggtattctccagcatattcgcgtattgccggtgattatccgcgcaattggtttcctgctctccaaagtcaacggcatgggcaaactggaatcctttaacgccgtcagctccctgattctgggtcagtctgaaaactttattgcctataaagatatcctcggcaaaatctcccgcaatcgtatgtacaccatggcagcaacggcgatgtccaccgtgtcgatgtccatcgttggtgcatatatgaccatgctggagccgaaatacgtcgttgcggcgctggtactgaacatgttcagcacctttatcgtgctgtcgctgatcaacccttaccgtgttgatgccagtgaagaaaacattcagatgtccaacctgcacgaaggtcagagcttcttcgaaatgctgggtgaatacattctggcaggtttcaaagttgccattatcgttgccgcgatgctgatcggctttatcgccctgatcgctgcactgaacgctctgtttgctaccgtgactggctggtttggctacagcatctccttccagggcatcctgggttacatcttctatccgattgcatgggtgatgggtgttccttccagtgaagcactgcaagtgggcagtatcatggcgaccaaactggtttccaacgagttcgttgcgatgatggatctgcagaaaattgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaa

SEQ ID NO: 858 - DNA, 3837 bp, Artificial Sequence
  Description of Artificial Sequence: Synthetic polynucleotide
  PfnrS-xdhABC
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatatgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 859 - DNA, 3624 bp, Artificial Sequence
  Description of Artificial Sequence: Synthetic polynucleotide
  xdhABC
atgcgcgtcgatgccattgctaaggtcaccgggcgggcacgatatactgacgattatattatggcgggcatgtgttacgcgaaatatgtacgtagccctatcgcacatggttatgctgtaaatattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgtcatgttcgtcatcatggtgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagataccgacgttacaccattcgaccccggcgcatttgcctcacgtcagagctatgttgccgcgcctgcgctgcgcagtgcagcactgttattaaaagagaaaatcatcgctcacgccgcagtcatgctacatcagtcagcgatgaatctgaccctgataaaaggccatatcgtgctgattgaaagaccggaagaaccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgcaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatcagcatacggacataagtcactgggtgagccccccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctctgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcgacctgggctgaaggaaaagagatccgcacgctggaaggtgaagcgaaaggcggtaaactttctcatgtccaactggcttatgcgaaatctggtgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaa

SEQ ID NO: 860 - DNA, 2803 bp, Artificial Sequence
  Description of Artificial Sequence: Synthetic polynucleotide
  PfnrS-add-xapA-deoD
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccaaagtgaactctagaaataattttgtttaactttaagaaggagatatacatatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaaaagaaggagatatacatatgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctgaaagaaggagatatacatatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 861 - DNA, 2633 bp, Artificial Sequence
  Description of Artificial Sequence: Synthetic polynucleotide
  add-xapA-deoD
ctctagaaataattttgtttaactttaagaaggagatatacatatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcgtttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgatgaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaaaagaaggagatatacatatgtatcaggctcagttttctcataacccactgtattgcgtagatattatcaagacttataaacctgatttcacgccacgagtggcctttattttaggttccgggctgggcgcgctggccgatcagattgagaacgcggtcgcaatttcctacgaaaagctgcctgggttcccggtaagtaccgtacacggtcatgcgggtgagctggtgctgggttatctccagggggtgccagtggcgtgtatgaaaggtcgcggacatttctacgaaggtcgtgggatgaccatcatgacggatgcaatccgtacctttaagttgctgggctgcgagttgctgttctgcaccaatgcggctggctcactgcgccctgaagtgggggccggcagtctggtcgcattgaaagatcacatcaacaccatgccgggaacgccgatggtgggtcttaatgatgaacgttttggtgagcgcttcttctcgctggcgaatgcctacgatgcggaataccgcgcactgttacaaaaagtggcgaaagaagaggggttccctctgacggagggcgtgttcgtctcatatccggggccgaatttcgagactgcggcggaaattcgcatgatgcaaattattggtggggatgttgttggtatgtctgtggtgcctgaggttatttcagctcgccattgcgaacttaaagtcgttgcggtctctgcgattaccaacatggcggaaggtctgagtgacgtgaagctttctcatgcccaaacgctggcagcagcggaactctcaaagcaaaactttattaatcttatttgcggctttctgcgcaaaattgcctgaaagaaggagatatacatatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactacgcgacgtcgttatcggtatgggtgcctgcaccgattccaaagttaaccgcatccgttttaaagaccatgactttgccgctatcgctgactttgacatggtgcgtaacgcggtagacgcggctaaagcactgggcgttgatgctcgcgtgggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcactggaatccgttctgctgggcgataaagagtaa

SEQ ID NO: 862 - DNA, 1053 bp, Artificial Sequence
  Description of Artificial Sequence: Synthetic polynucleotide
  fbrAroG
atgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 863 - DNA, 2351 bp, Artificial Sequence
  Description of Artificial Sequence: Synthetic polynucleotide
  fbrAroG-serA
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 864 - DNA, 1233 bp, Artificial Sequence
  Description of Artificial Sequence: Synthetic polynucleotide
  SerA
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 865 - DNA, 1424 bp, Artificial Sequence
  Description of Artificial Sequence: Synthetic polynucleotide
  Ptet-kynU(Pseudomonas)
atctaatctagacatcattaattcctaatttttgttgacactctatcattgatagagttattttaccactccctatcagtgatagagaaaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 866 - DNA, 1571 bp, Artificial Sequence
  Description of Artificial Sequence: Synthetic polynucleotide
  Ptet-kynU(Human)
atctaatctagacatcattaattcctaatttttgttgacactctatcattgatagagttattttaccactccctatcagtgatagagaaaagtgaatatcaagacacgaggaggtaagattatggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 867 - DNA, 1310 bp, Artificial Sequence
  Description of Artificial Sequence: Synthetic polynucleotide
  ptet-kynU(Shewanella)
atctaatctagacatcattaattcctaatttttgttgacactctatcattgatagagttattttaccactccctatcagtgatagagaaaagtgaatggttcaccaccacaaggagggattatgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 868 - DNA, 1096 bp, Artificial Sequence
  Description of Artificial Sequence: Synthetic polynucleotide
  fbrAroG
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 869 - DNA, 28 bp, Artificial Sequence
  Description of Artificial Sequence: Synthetic oligonucleotide
  BBa_J61133
tctagagaaagacccgagacactagatg

SEQ ID NO: 870 - DNA, 28 bp, Artificial Sequence
  Description of Artificial Sequence: Synthetic oligonucleotide
  BBa_J61134
tctagagaaagaccggaaatactagatg

SEQ ID NO: 871 - DNA, 28 bp, Artificial Sequence
  Description of Artificial Sequence: Synthetic oligonucleotide
  BBa_J61135
tctagagaaagaccggagacactagatg

SEQ ID NO: 872 - DNA, 6573 bp, Artificial Sequence
  Description of Artificial Sequence: Synthetic polynucleotide
  TrpEDCBA
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagtta

SEQ ID NO: 873 - DNA, 28 bp, Artificial Sequence
  Description of Artificial Sequence: Synthetic oligonucleotide
  BBa_J61132
tctagagaaagacaggattaactagatg

SEQ ID NO: 874 - DNA, 28 bp, Artificial Sequence
  Description of Artificial Sequence: Synthetic oligonucleotide
  BBa_J61136
tctagagaaagagctgagcaactagatg

SEQ ID NO: 875 - DNA, 28 bp, Artificial Sequence
  Description of Artificial Sequence: Synthetic oligonucleotide
  BBa_J61137
tctagagaaagagtagatcaactagatg

SEQ ID NO: 876 - DNA, 28 bp, Artificial Sequence
  Description of Artificial Sequence: Synthetic oligonucleotide
  BBa_J61138
tctagagaaagatatgaataactagatg

SEQ ID NO: 877 - DNA, 28 bp, Artificial Sequence
  Description of Artificial Sequence: Synthetic oligonucleotide
  BBa_J61139
tctagagaaagattagagtcactagatg

SEQ ID NO: 878 - DNA, 6574 bp, Artificial Sequence
  Description of Artificial Sequence: Synthetic polynucleotide
  fbrS40FTrpE-DCBA
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 879 - DNA, 1562 bp, Artificial Sequence
  Description of Artificial Sequence: Synthetic polynucleotide
  fbrTrpE
atgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 880 - DNA, 31 bp, Artificial Sequence
  Description of Artificial Sequence: Synthetic oligonucleotide
  BBa_B0029
tctagagttcacacaggaaacctactagatg

SEQ ID NO: 881 - DNA, 31 bp, Artificial Sequence
  Description of Artificial Sequence: Synthetic oligonucleotide
  BBa_B0030
tctagagattaaagaggagaaatactagatg

SEQ ID NO: 882 - DNA, 30 bp, Artificial Sequence
  Description of Artificial Sequence: Synthetic oligonucleotide
  BBa_B0031
tctagagtcacacaggaaacctactagatg

SEQ ID NO: 883 - DNA, 29 bp, Artificial Sequence
  Description of Artificial Sequence: Synthetic oligonucleotide
  BBa_B0032
tctagagtcacacaggaaagtactagatg

SEQ ID NO: 884 - DNA, 27 bp, Artificial Sequence
  Description of Artificial Sequence: Synthetic oligonucleotide
  BBa_B0033
tctagagtcacacaggactactagatg

SEQ ID NO: 885 - DNA, 28 bp, Artificial Sequence
  Description of Artificial Sequence: Synthetic oligonucleotide
  BBa_B0034
tctagagaaagaggagaaatactagatg

SEQ ID NO: 886 - DNA, 30 bp, Artificial Sequence
  Description of Artificial Sequence: Synthetic oligonucleotide
  BBa_B0035
tctagagattaaagaggagaatactagatg

SEQ ID NO: 887 - DNA, 28 bp, Artificial Sequence
  Description of Artificial Sequence: Synthetic oligonucleotide
  BBa_B0064
tctagagaaagaggggaaatactagatg

SEQ ID NO: 888 - DNA, 64 bp, Artificial Sequence; identical to SEQ ID NO: 744
  Description of Artificial Sequence: Synthetic oligonucleotide
  SYN23119 promoter

SEQ ID NO: 889 - DNA, 94 bp, Artificial Sequence
  Description of Artificial Sequence: Synthetic oligonucleotide
  SYN23119 promoter with RBS
ggaaaatttttttaaaaaaaaaacttgacagctagctcagtccttggtataatgctagcacgaagtgaattatataaaagtgggaggtgcccga

SEQ ID NO: 890 - DNA, 1225 bp, Artificial Sequence
  Description of Artificial Sequence: Synthetic polynucleotide
  Pseudomonas fluorescens, codon optimized for expression in E. coli, driven by the SYN23119 Construct can be expressed from a plasmid, e.g., p15 or can be integrated into the chromosome, e.g., at the HA3/4 site
ggaaaatttttttaaaaaaaaaacttgacagctagctcagtccttggtataatgctagcacgaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggt

SEQ ID NO: 891 - DNA, 66 bp, Artificial Sequence; identical to SEQ ID NO: 740
  Description of Artificial Sequence: Synthetic oligonucleotide
  Lpp promoter from E. coli SEQ ID NO: 891

SEQ ID NO: 892 - DNA, 96 bp, Artificial Sequence
  Description of Artificial Sequence: Synthetic oligonucleotide
  Lpp promoter from E. coli SEQ ID NO: 892
ataagtgccttcccatcaaaaaaatattctcaacataaaaaactttgtgtaatacttgtaacgctagtgaattatataaaagtgggaggtgcccga

SEQ ID NO: 893 - DNA, 1347 bp, Artificial Sequence
  Description of Artificial Sequence: Synthetic polynucleotide
  Pseudomonas fluorescens kynureninase driven by Lpp promoter from E. coli SEQ ID NO: 893 Construct can be expressed from a plasmid, e.g., p15 or can be integrated into the chromosome, e.g., at the HA3/4 site
ataagtgccttcccatcaaaaaaatattctcaacataaaaaactttgtgtaatacttgtaacgctagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaa

SEQ ID NO: 894 - DNA, 138 bp, Artificial Sequence
  Description of Artificial Sequence: Synthetic polynucleotide
  fliC-FliC20
tgacggcgattgagccgacgggtggaaacccaaaacgtaatcaacgtgggtactccttaaattgggttcgaatggaccatggcacaagtcattaataccaacagcctctcgctgatcactcaaaataatatcaacaag

SEQ ID NO: 895 - DNA, 70 bp, Artificial Sequence
  Description of Artificial Sequence: Synthetic oligonucleotide
  fliC-RBS
tgacggcgattgagccgacgggtggaaacccaaaacgtaatcaactacgaacacttacaggaggtaccca

SEQ ID NO: 896 - DNA, 70 bp, Artificial Sequence
  Description of Artificial Sequence: Synthetic oligonucleotide
  fliC-RBS
tgacggcgattgagccgacgggtggaaacccaaaacgtaatcaacaagtataaactctgggaggttccta

SEQ ID NO: 897 - DNA, 70 bp, Artificial Sequence
  Description of Artificial Sequence: Synthetic oligonucleotide
  fliC-RBS
tgacggcgattgagccgacgggtggaaacccaaaacgtaatcaactcaaatcccttaataaggaggtaaa

SEQ ID NO: 898 - DNA, 106 bp, Artificial Sequence
  Description of Artificial Sequence: Synthetic polynucleotide
  RBS-phoA
ctctagaaataattttgtttaactttaagaaggagatatacatatgaaacaaagcactattgcactggcactcttaccgttactgtttacccctgtgacaaaagcg

SEQ ID NO: 899 - DNA, 63 bp, Artificial Sequence
  Description of Artificial Sequence: Synthetic oligonucleotide
  phoA
atgaaacaaagcactattgcactggcactcttaccgttactgtttacccctgtgacaaaagcg

SEQ ID NO: 900 - DNA, 109 bp, Artificial Sequence
  Description of Artificial Sequence: Synthetic polynucleotide
  RBS-ompF
ctctagaaataattttgtttaactttaagaaggagatatacatatgatgaagcgcaatattctggcagtgatcgtccctgctctgttagtagcaggtactgcaaacgct

SEQ ID NO: 901 - DNA, 66 bp, Artificial Sequence
  Description of Artificial Sequence: Synthetic oligonucleotide
  ompF
atgatgaagcgcaatattctggcagtgatcgtccctgctctgttagtagcaggtactgcaaacgct

SEQ ID NO: 902 - DNA, 88 bp, Artificial Sequence
  Description of Artificial Sequence: Synthetic oligonucleotide
  RBS-cvaC
ctctagaaataattttgtttaactttaagaaggagatatacatatgagaactctgactctaaatgaattagattctgtttctggtggt

SEQ ID NO: 903 - DNA, 45 bp, Artificial Sequence
  Description of Artificial Sequence: Synthetic oligonucleotide
  cvaC
atgagaactctgactctaaatgaattagattctgtttctggtggt

SEQ ID NO: 904 - DNA, 88 bp, Artificial Sequence
  Description of Artificial Sequence: Synthetic oligonucleotide
  RBS-phoA (Optimized)
gacgccagagagttaagggggttaaatgaaacaatcgaccatcgcattggcgctgcttcctctattgttcacaccggtgacaaaggca

SEQ ID NO: 905 - DNA, 63 bp, Artificial Sequence
  Description of Artificial Sequence: Synthetic oligonucleotide
  Optimized phoA
atgaaacaatcgaccatcgcattggcgctgcttcctctattgttcacaccggtgacaaaggca

SEQ ID NO: 906 - DNA, 160 bp, Artificial Sequence
  Description of Artificial Sequence: Synthetic polynucleotide
  RBS-TorA
ctctagaaataattttgtttaactttaagaaggagatatacatatgaacaataacgatctctttcaggcatcacgtcggcgttttctggcacaactcggcggcttaaccgtcgccgggatgctggggccgtcattgttaacgccgcgacgtgcgactgcg

SEQ ID NO: 907 - DNA, 117 bp, Artificial Sequence
  Description of Artificial Sequence: Synthetic polynucleotide
  TorA
atgaacaataacgatctctttcaggcatcacgtcggcgttttctggcacaactcggcggcttaaccgtcgccgggatgctggggccgtcattgttaacgccgcgacgtgcgactgcg

SEQ ID NO: 908 - DNA, 148 bp, Artificial Sequence
  Description of Artificial Sequence: Synthetic polynucleotide
  RBS-TorA alternate
cccacattcgaggtactaaatgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 909 - DNA, 129 bp, Artificial Sequence
  Description of Artificial Sequence: Synthetic polynucleotide
  TorA (alternate)
atgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 910 - DNA, 130 bp, Artificial Sequence
  Description of Artificial Sequence: Synthetic polynucleotide
  RBS-fdnG
accctattacacacctaaggaggccaaatacatggacgtcagtcgcagacaattttttaaaatctgcgcgggcggtatggcgggaacaacagtagcagcattgggctttgccccgaagcaagcactggct

SEQ ID NO: 911 - DNA, 99 bp, Artificial Sequence
  Description of Artificial Sequence: Synthetic oligonucleotide
  fdnG
atggacgtcagtcgcagacaattttttaaaatctgcgcgggcggtatggcgggaacaacagtagcagcattgggctttgccccgaagcaagcactggct

SEQ ID NO: 912 - DNA, 168 bp, Artificial Sequence
  Description of Artificial Sequence: Synthetic polynucleotide
  RBS-dmsA
tacgcaaaaaacataatttaagagaggataaacatgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 913 - DNA, 135 bp, Artificial Sequence
  Description of Artificial Sequence: Synthetic polynucleotide
  dmsA
atgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 914 - DNA, 712 bp, Artificial Sequence
  Description of Artificial Sequence: Synthetic polynucleotide
  TetR/TetA Promoter
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaa

SEQ ID NO: 915 - DNA, 104 bp, Artificial Sequence; identical to SEQ ID NO: 801
  Description of Artificial Sequence: Synthetic polynucleotide
  fliC Promoter

SEQ ID NO: 916 - DNA, 162 bp, Artificial Sequence
  Description of Artificial Sequence: Synthetic polynucleotide
  FnrS Promoter
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatcc

SEQ ID NO: 917 - DNA, 358 bp, Artificial Sequence
  Description of Artificial Sequence: Synthetic polynucleotide
  DOM Construct Terminator
cacatttccccgaaaagtgccgatggccccccgatggtagtgtggcccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttc

SEQ ID NO: 918 - DNA, 48 bp, Artificial Sequence
  Description of Artificial Sequence: Synthetic oligonucleotide
  FRT Site
gaagttcctatactttctagagaataggaacttcggaataggaacttc

SEQ ID NO: 919 - DNA, 1345 bp, Artificial Sequence
  Description of Artificial Sequence: Synthetic polynucleotide
  Kanamycin Resistance Cassette (for integration in between FRT sites)
aagatcccctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccagcttcaaaagcgctct

SEQ ID NO: 920 - protein, 219 aa, Artificial Sequence
  Description of Artificial Sequence: Synthetic polypeptide
  human IL-12a construct with a N terminal OmpF secretion tag (sec-dependent secretion system)
MMKRNILAVIVPALLVAGTANARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 921 - protein, 218 aa, Artificial Sequence
  Description of Artificial Sequence: Synthetic polypeptide
  human IL-12a construct with a N terminal PhoA secretion
MKQSTIALALLPLLFTPVTKARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 922 - protein, 236 aa, Artificial Sequence
  Description of Artificial Sequence: Synthetic polypeptide
  human IL-12a construct with a N terminal TorA secretion tag (sec-dependent secretion system)
MNNNDLFQASRRRFLAQLGGLTVAGMLGPSLLTPRRATARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 923 - protein, 328 aa, Artificial Sequence
  Description of Artificial Sequence: Synthetic polypeptide
  human IL-12b construct with a N terminal OmpF secretion tag (sec-dependent secretion system)
MMKRNILAVIVPALLVAGTANAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 924 - protein, 327 aa, Artificial Sequence
  Description of Artificial Sequence: Synthetic polypeptide
  human IL-12b construct with a N terminal PhoA secretion tag
MKQSTIALALLPLLFTPVTKAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 925 - protein, 345 aa, Artificial Sequence
  Description of Artificial Sequence: Synthetic polypeptide
  human IL-12 construct with a N terminal TorA secretion tag (sec-dependent secretion system)
MNNNDLFQASRRRFLAQLGGLTVAGMLGPSLLTPRRATAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 926 - protein, 219 aa, Artificial Sequence; identical to SEQ ID NO: 920
  Description of Artificial Sequence: Synthetic polypeptide
  murine IL-12a construct with a N terminal OmpF secretion tag (sec-dependent secretion system)

SEQ ID NO: 927 - protein, 218 aa, Artificial Sequence; identical to SEQ ID NO: 921
  Description of Artificial Sequence: Synthetic polypeptide
  murine IL-12a construct with a N terminal PhoA secretion tag

SEQ ID NO: 928 - protein, 236 aa, Artificial Sequence; identical to SEQ ID NO: 922
  Description of Artificial Sequence: Synthetic polypeptide
  murine IL-12a construct with a N terminal TorA secretion tag (sec-dependent secretion system)

SEQ ID NO: 929 - protein, 335 aa, Artificial Sequence
  Description of Artificial Sequence: Synthetic polypeptide
  murine IL-12b construct with a N terminal OmpF secretion tag (sec-dependent secretion system)
MMKRNILAVIVPALLVAGTANAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 930 - protein, 334 aa, Artificial Sequence
  Description of Artificial Sequence: Synthetic polypeptide
  murine IL-12b construct with a N terminal PhoA secretion tag
MKQSTIALALLPLLFTPVTKAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 931 - protein, 352 aa, Artificial Sequence
  Description of Artificial Sequence: Synthetic polypeptide
  murine IL-12b construct with a N terminal TorA secretion tag (sec-dependent secretion system)
MNNNDLFQASRRRFLAQLGGLTVAGMLGPSLLTPRRATAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 932 - protein, 149 aa, Artificial Sequence
  Description of Artificial Sequence: Synthetic polypeptide
  human GMCSF construct with a N terminal OmpF secretion tag (sec-dependent secretion system)
MMKRNILAVIVPALLVAGTANAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 933 - protein, 148 aa, Artificial Sequence
  Description of Artificial Sequence: Synthetic polypeptide
  human GMCSF construct with a N terminal PhoA secretion tag
MKQSTIALALLPLLFTPVTKAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 934 - protein, 166 aa, Artificial Sequence
  Description of Artificial Sequence: Synthetic polypeptide
  human GMCSF construct with a N terminal TorA secretion tag (sec-dependent secretion system)
MNNNDLFQASRRRFLAQLGGLTVAGMLGPSLLTPRRATAAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 935 - protein, 136 aa, Artificial Sequence
  Description of Artificial Sequence: Synthetic polypeptide
  human Il-15 construct with a N terminal OmpF secretion tag (sec-dependent secretion system)
MMKRNILAVIVPALLVAGTANANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 936 - protein, 135 aa, Artificial Sequence
  Description of Artificial Sequence: Synthetic polypeptide
  human Il-15 construct with a N terminal PhoA secretion tag
MKQSTIALALLPLLFTPVTKANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 937 - protein, 153 aa, Artificial Sequence
  Description of Artificial Sequence: Synthetic polypeptide
  human Il-15 construct with a N terminal TorA secretion tag (sec-dependent secretion system)
MNNNDLFQASRRRFLAQLGGLTVAGMLGPSLLTPRRATANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 938 - protein, 199 aa, Artificial Sequence
  Description of Artificial Sequence: Synthetic polypeptide
  human TNFa construct with a N terminal OmpF secretion tag (sec-dependent secretion system)
MMKRNILAVIVPALLVAGTANAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 939 - protein, 198 aa, Artificial Sequence
  Description of Artificial Sequence: Synthetic polypeptide
  human TNFa construct with a N terminal PhoA secretion tag
MKQSTIALALLPLLFTPVTKAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 940 - protein, 216 aa, Artificial Sequence
  Description of Artificial Sequence: Synthetic polypeptide
  human TNFa construct with a N terminal TorA secretion tag (sec-dependent secretion system)
MNNNDLFQASRRRFLAQLGGLTVAGMLGPSLLTPRRATAGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 941 - protein, 160 aa, Artificial Sequence
  Description of Artificial Sequence: Synthetic polypeptide
  human IFNg construct with a N terminal OmpF secretion tag (sec-dependent secretion system)
MMKRNILAVIVPALLVAGTANAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 942 - protein, 159 aa, Artificial Sequence
  Description of Artificial Sequence: Synthetic polypeptide
  human IFNg construct with a N terminal PhoA secretion tag
MKQSTIALALLPLLFTPVTKAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 943 - protein, 177 aa, Artificial Sequence
  Description of Artificial Sequence: Synthetic polypeptide
  human IFNg construct with a N terminal TorA secretion tag (sec-dependent secretion system)
MNNNDLFQASRRRFLAQLGGLTVAGMLGPSLLTPRRATAQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 944-952 - skipped (9 entries)

SEQ ID NO: 953 - DNA, 657 bp, Artificial Sequence
  Description of Artificial Sequence: Synthetic polynucleotide
  human IL-12a construct with a N terminal PhoA secretion tag
atgaaacagagcacaattgctctggccttgttgccattactgtttacccctgttactaaggctaggaacctgcctgtggcaacaccagaccctgggatgttcccttgcttacatcattcccagaacctgttgcgtgcggtgtctaacatgctgcagaaagccaggcagacgctggaattctacccatgcacttccgaagagatagatcatgaagacattacgaaagacaaaacctcaacggttgaagcatgcttacctctggaattgactaagaatgaatcgtgcttaaactcaagagagaccagtttcatcactaatggctcttgcttagcgtcgcgcaagaccagcttcatgatggcgctctgcctaagtagcatctacgaggacctcaaaatgtaccaagttgaatttaaaactatgaatgccaaacttctaatggacccaaaaagacagatatttttagatcagaatatgcttgcggttattgacgaactcatgcaggcattgaattttaattccgagacggtgccacaaaaaagttctttggaggagccggacttttacaagacaaaaatcaagctgtgcatacttcttcacgcattcagaatacgggccgttacgatcgatcgcgtcatgtcgtatcttaatgcgagctga

SEQ ID NO: 954 - DNA, 987 bp, Artificial Sequence
  Description of Artificial Sequence: Synthetic polynucleotide
  human IL-12b construct with a N terminal PhoA secretion tag
atgaagcagagcacgatcgcattggcgttgctaccgctgttgtttaccccggtcacaaaagccatctgggaactgaaaaaagatgtttatgtagttgaactggattggtacccggatgcacccggtgagatggtggttttgacctgcgacacgccggaagaagatggcataacgtggaccctggatcaaagctctgaagttctgggttcaggtaagacattgacgatccaagtaaaagaatttggcgacgcaggtcagtacacctgccacaaaggtggcgaagttctgtcgcactcactcctgctcctgcacaaaaaagaggatggcatctggagtactgatatcctaaaggatcaaaaagaacctaaaaacaaaacgttcttgcgctgtgaagcgaagaactatagtggtcgctttacgtgctggtggttgactaccatttccaccgatttgaccttttctgttaagagttcgcgcggctcgtcagatccgcagggcgttacttgcggtgcggcgacgctgtcagctgagagagttcgtggggacaacaaagagtacgaatatagtgtagaatgtcaagaggattcggcgtgcccggcagcagaggagtctctccccattgaagttatggtggacgcagtgcataaactgaaatatgagaattacacatcaagcttttttattcgcgatatcatcaaaccggatcctccaaaaaatctgcaactaaagcccctgaaaaattcgcgccaagttgaggtgagctgggaatatccggatacttggtcgacaccgcattcttatttctcactgaccttctgcgttcaggttcaaggtaaatcaaaacgagaaaaaaaggatcgcgtctttaccgacaaaacgtctgctactgtaatctgccgcaagaatgcgtcaatttctgtacgtgcgcaagatcgctactactctagtagttggtctgaatgggcttcagtgccatgctcctgatga

SEQ ID NO: 955 - DNA, 657 bp, Artificial Sequence
  Description of Artificial Sequence: Synthetic polynucleotide
  murine IL-12a construct with a N terminal PhoA secretion tag
atgaaacagagtacgatagccctagccctgttgccgctcctgttcacccccgttactaaagcacgtaaccttccggtggccacgccagatccgggcatgttcccgtgcttacaccattcccagaatctgctgcgcgctgtgagtaatatgctgcagaaggcgagacaaactttggaattttacccgtgcacttcggaggagattgaccatgaggatatcacaaaagacaaaaccagtacagtggaagcctgcctgccccttgaactgactaaaaatgagagttgtttaaattcacgcgaaaccagcttcattactaacggaagctgcttagcatcgcggaaaaccagttttatgatggccctttgcctttcatctatttacgaggaccttaaaatgtatcaagttgaatttaagactatgaacgcgaaactgctaatggatcccaagcgacaaatctttcttgatcaaaatatgttggctgttattgatgaactgatgcaagccctgaattttaactcagaaaccgtacctcagaaatcgagtttagaagaacccgatttctacaaaactaaaatcaagttgtgtatccttttacatgccttccggattcgggccgtcactattgatcgcgtgatgtcgtacttgaatgcctcctaa

SEQ ID NO: 956 - DNA, 1005 bp, Artificial Sequence
  Description of Artificial Sequence: Synthetic polynucleotide
  murine IL-12b construct with a N terminal PhoA secretion tag
atgaaacagagcacgatcgcacttgcccttttgccgctgttatttaccccagtgacgaaagccatgtgggaattggaaaaagacgtgtatgttgttgaagttgactggactccggacgcgcctggtgaaactgttaatctgacttgtgatacaccggaggaagatgatataacttggactagcgatcaacgacacggcgtaatcggctctggtaagactttgaccattactgtgaaggaattcttggatgcggggcaatatacgtgtcataaaggcggcgagacgctgtcacactctcacctgttgttacataaaaaagagaatggtatatggtctacggagatcttgaaaaactttaaaaacaaaacttttttgaagtgtgaggctccaaactattctggtcgctttacctgtagttggttggtgcaacgtaacatggatctcaaatttaacataaagtcgtcttcgtcttctcccgatagccgagcggttacctgtggcatggctagtttgtcggcggagaaggtgaccttggatcaacgtgattatgaaaaatatagcgtttcgtgccaagaggacgttacgtgccctaccgctgaagagactttgccgattgaattggcactggaagcacgacaacaaaataaatacgagaattactcaactagtttcttcatccgagatatcataaaaccggaccccccgaagaatctgcaaatgaaaccgcttaaaaattcacaggtagaggtttcgtgggagtacccggatagttggtctacgcctcattcgtattttagcctgaaatttttcgttcgaatacagcgaaaaaaagagaagatgaaagaaactgaagaagggtgtaaccaaaaaggtgcatttctggtggagaaaactagcaccgaggttcaatgcaaaggcggtaacgtgtgcgtacaagctcaagaccgttattataacagtagctgttctaaatgggcttgcgtgccctgccgcgtgagatcatga

SEQ ID NO: 957 - DNA, 408 bp, Artificial Sequence
  Description of Artificial Sequence: Synthetic polynucleotide
  human Il-15 construct with a N terminal PhoA secretion tag
atgaagcaatctacgatcgcactagcgttactgccgttattgtttactcctgtgactaaggctaattgggttaatgttatatctgatttgaaaaaaatagaggatctgattcaatcaatgcacatagatgcgactctgtatactgagagcgatgtgcacccgagttgcaaagttactgctatgaaatgttttctgctggagctgcaagttatctctctggagagtggtgatgcgtctattcacgatactgttgagaatctgattattctggctaataactcgctgtcaagtaatgggaatgttacggaatctggctgtaaggagtgtgaagaattagaagaaaaaaatattaaagagtttctgcagagttttgtgcacattgttcagatgtttatcaatactagctga

SEQ ID NO: 958 - DNA, 447 bp, Artificial Sequence
  Description of Artificial Sequence: Synthetic polynucleotide
  human GMCSF construct with a N terminal PhoA secretion tag
atgaagcaatctacgatcgcgttggccttactgcccctgttattcacacccgtgaccaaagcggcaccggcccgcagcccatcaccgtcaactcaaccttgggaacatgtaaatgctattcaagaagctcgccgcctgttgaatttgagtcgcgatactgcagcagagatgaatgagactgtagaggtgatttcagaaatgtttgacctgcaggagccgacttgtttgcaaactcgcctggagctgtacaaacaaggcctgcgtggctcgctgactaaactgaaaggtcctctgacgatgatggcttctcattataaacaacactgcccgcctactccggagacgtcttgcgcgacccagataattacttttgaatcttttaaagagaatctgaaagactttctgctggttatcccgtttgattgttgggaaccggttcaagaataa

SEQ ID NO: 959 - DNA, 597 bp, Artificial Sequence
  Description of Artificial Sequence: Synthetic polynucleotide
  human TNFa construct with a N terminal PhoA secretion tag
atgaaacaatcaacgatcgctctggctctgcttccgctgctctttactccagttactaaagcgggtccgcagagggaagaattcccgcgcgatttgagcctgatttcacctcttgctcaggctgtccgctcctcttcgcgtaccccctcggataaacctgtcgcgcacgtggttgcgaacccgcaagcggaagggcagctgcaatggttaaaccgccgggctaatgcactgctggctaatggagttgagttacgcgacaaccaacttgtcgttccttcggaagggctgtatctgatctattcacaggttctctttaaagggcagggttgcccatcaacccacgtgctcctgacacacacgatcagtcgtatcgcggtatcctatcagacgaaagttaacctcctgtcagcgattaaatcgccgtgtcagagagaaactccagagggtgcggaagctaaaccgtggtatgaacctatttatcttggtggagttttccagttggaaaaaggtgatagactgtcggcagagatcaatcgccctgattacctggatttcgctgagtcgggtcaggtttatttcggaattattgcactgtga

SEQ ID NO: 960 - DNA, 480 bp, Artificial Sequence
  Description of Artificial Sequence: Synthetic polynucleotide
  human IFNg construct with a N terminal PhoA secretion tag
atgaagcaatctacgatagcactggcgttgctgccgctgctgttcaccccggttaccaaggcgcaggatccttacgttaaagaagcagagaatctgaaaaaatactttaatgcaggccacagcgatgtggcagataatggcacgttattcctgggcattctgaaaaattggaaagaagaatctgaccggaagatcatgcaatctcagatcgtatcattttatttcaagttgtttaaaaacttcaaggatgaccagtcgattcaaaaatcagtggaaacgatcaaagaagatatgaacgttaagttcttcaactcaaataaaaaaaaacgcgatgatttcgaaaaactgactaattattcggtaactgatttgaatgttcagcgcaaggcgattcatgaattgattcaggttatggcagaactgtcgccagcggcaaaaacgggtaaacgaaaacgttctcagatgttgtttcgtggttga

SEQ ID NO: 961-964 - skipped (4 entries)

SEQ ID NO: 965 - DNA, 2531 bp, Artificial Sequence
  Description of Artificial Sequence: Synthetic polynucleotide
  Ptet.phoA-hIL12b-phoA-hIL12a
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaataagtcataaatagggagtccaaaatgaagcagagcacgatcgcattggcgttgctaccgctgttgtttaccccggtcacaaaagccatctgggaactgaaaaaagatgtttatgtagttgaactggattggtacccggatgcacccggtgagatggtggttttgacctgcgacacgccggaagaagatggcataacgtggaccctggatcaaagctctgaagttctgggttcaggtaagacattgacgatccaagtaaaagaatttggcgacgcaggtcagtacacctgccacaaaggtggcgaagttctgtcgcactcactcctgctcctgcacaaaaaagaggatggcatctggagtactgatatcctaaaggatcaaaaagaacctaaaaacaaaacgttcttgcgctgtgaagcgaagaactatagtggtcgctttacgtgctggtggttgactaccatttccaccgatttgaccttttctgttaagagttcgcgcggctcgtcagatccgcagggcgttacttgcggtgcggcgacgctgtcagctgagagagttcgtggggacaacaaagagtacgaatatagtgtagaatgtcaagaggattcggcgtgcccggcagcagaggagtctctccccattgaagttatggtggacgcagtgcataaactgaaatatgagaattacacatcaagcttttttattcgcgatatcatcaaaccggatcctccaaaaaatctgcaactaaagcccctgaaaaattcgcgccaagttgaggtgagctgggaatatccggatacttggtcgacaccgcattcttatttctcactgaccttctgcgttcaggttcaaggtaaatcaaaacgagaaaaaaaggatcgcgtctttaccgacaaaacgtctgctactgtaatctgccgcaagaatgcgtcaatttctgtacgtgcgcaagatcgctactactctagtagttggtctgaatgggcttcagtgccatgctcctgatgagaaaccctacggaggaggttaatttatgaaacagagcacaattgctctggccttgttgccattactgtttacccctgttactaaggctaggaacctgcctgtggcaacaccagaccctgggatgttcccttgcttacatcattcccagaacctgttgcgtgcggtgtctaacatgctgcagaaagccaggcagacgctggaattctacccatgcacttccgaagagatagatcatgaagacattacgaaagacaaaacctcaacggttgaagcatgcttacctctggaattgactaagaatgaatcgtgcttaaactcaagagagaccagtttcatcactaatggctcttgcttagcgtcgcgcaagaccagcttcatgatggcgctctgcctaagtagcatctacgaggacctcaaaatgtaccaagttgaatttaaaactatgaatgccaaacttctaatggacccaaaaagacagatatttttagatcagaatatgcttgcggttattgacgaactcatgcaggcattgaattttaattccgagacggtgccacaaaaaagttctttggaggagccggacttttacaagacaaaaatcaagctgtgcatacttcttcacgcattcagaatacgggccgttacgatcgatcgcgtcatgtcgtatcttaatgcgagctgaaaataaaacgaaaggctcagtcgaaagactgggcctttcgttttatctgttggttccttatcatctggcgaatcggacccacaagagcactg

SEQ ID NO: 966 - DNA, 2549 bp, Artificial Sequence
  Description of Artificial Sequence: Synthetic polynucleotide
  Ptet.phoA-mIL12b-phoA-mIL12a
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaatgttacacatctaaggagaaacattatgaaacagagcacgatcgcacttgcccttttgccgctgttatttaccccagtgacgaaagccatgtgggaattggaaaaagacgtgtatgttgttgaagttgactggactccggacgcgcctggtgaaactgttaatctgacttgtgatacaccggaggaagatgatataacttggactagcgatcaacgacacggcgtaatcggctctggtaagactttgaccattactgtgaaggaattcttggatgcggggcaatatacgtgtcataaaggcggcgagacgctgtcacactctcacctgttgttacataaaaaagagaatggtatatggtctacggagatcttgaaaaactttaaaaacaaaacttttttgaagtgtgaggctccaaactattctggtcgctttacctgtagttggttggtgcaacgtaacatggatctcaaatttaacataaagtcgtcttcgtcttctcccgatagccgagcggttacctgtggcatggctagtttgtcggcggagaaggtgaccttggatcaacgtgattatgaaaaatatagcgtttcgtgccaagaggacgttacgtgccctaccgctgaagagactttgccgattgaattggcactggaagcacgacaacaaaataaatacgagaattactcaactagtttcttcatccgagatatcataaaaccggaccccccgaagaatctgcaaatgaaaccgcttaaaaattcacaggtagaggtttcgtgggagtacccggatagttggtctacgcctcattcgtattttagcctgaaatttttcgttcgaatacagcgaaaaaaagagaagatgaaagaaactgaagaagggtgtaaccaaaaaggtgcatttctggtggagaaaactagcaccgaggttcaatgcaaaggcggtaacgtgtgcgtacaagctcaagaccgttattataacagtagctgttctaaatgggcttgcgtgccctgccgcgtgagatcatgagaagaagattattgaagaggtccgcatgaaacagagtacgatagccctagccctgttgccgctcctgttcacccccgttactaaagcacgtaaccttccggtggccacgccagatccgggcatgttcccgtgcttacaccattcccagaatctgctgcgcgctgtgagtaatatgctgcagaaggcgagacaaactttggaattttacccgtgcacttcggaggagattgaccatgaggatatcacaaaagacaaaaccagtacagtggaagcctgcctgccccttgaactgactaaaaatgagagttgtttaaattcacgcgaaaccagcttcattactaacggaagctgcttagcatcgcggaaaaccagttttatgatggccctttgcctttcatctatttacgaggaccttaaaatgtatcaagttgaatttaagactatgaacgcgaaactgctaatggatcccaagcgacaaatctttcttgatcaaaatatgttggctgttattgatgaactgatgcaagccctgaattttaactcagaaaccgtacctcagaaatcgagtttagaagaacccgatttctacaaaactaaaatcaagttgtgtatccttttacatgccttccggattcgggccgtcactattgatcgcgtgatgtcgtacttgaatgcctcctaaaaataaaacgaaaggctcagtcgaaagactgggcctttcgttttatctgttggttccttatcatctggcgaatcggacccacaagagcactg

SEQ ID NO: 967 - DNA, 1270 bp, Artificial Sequence
  Description of Artificial Sequence: Synthetic polynucleotide
  Ptet.phoA-IL15
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagatcaactcaagataaggaggatccatgaagcaatctacgatcgcactagcgttactgccgttattgtttactcctgtgactaaggctaattgggttaatgttatatctgatttgaaaaaaatagaggatctgattcaatcaatgcacatagatgcgactctgtatactgagagcgatgtgcacccgagttgcaaagttactgctatgaaatgttttctgctggagctgcaagttatctctctggagagtggtgatgcgtctattcacgatactgttgagaatctgattattctggctaataactcgctgtcaagtaatgggaatgttacggaatctggctgtaaggagtgtgaagaattagaagaaaaaaatattaaagagtttctgcagagttttgtgcacattgttcagatgtttatcaatactagctgaaaataaaacgaaaggctcagtcgaaagactgggcctttcgttttatctgttggttccttatcatctggcgaatcggacccacaagagcactg

SEQ ID NO: 968 - DNA, 1309 bp, Artificial Sequence
  Description of Artificial Sequence: Synthetic polynucleotide
  Ptet.phoA-GMCSF
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagaaagcaacaacatagggggaaagaatgaagcaatctacgatcgcgttggccttactgcccctgttattcacacccgtgaccaaagcggcaccggcccgcagcccatcaccgtcaactcaaccttgggaacatgtaaatgctattcaagaagctcgccgcctgttgaatttgagtcgcgatactgcagcagagatgaatgagactgtagaggtgatttcagaaatgtttgacctgcaggagccgacttgtttgcaaactcgcctggagctgtacaaacaaggcctgcgtggctcgctgactaaactgaaaggtcctctgacgatgatggcttctcattataaacaacactgcccgcctactccggagacgtcttgcgcgacccagataattacttttgaatcttttaaagagaatctgaaagactttctgctggttatcccgtttgattgttgggaaccggttcaagaataaaaataaaacgaaaggctcagtcgaaagactgggcctttcgttttatctgttggttccttatcatctggcgaatcggacccacaagagcactg

SEQ ID NO: 969 - DNA, 1459 bp, Artificial Sequence
  Description of Artificial Sequence: Synthetic polynucleotide
  Ptet-phoA-TNFa
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacacaacacagaaaggagggctgtccatgaaacaatcaacgatcgctctggctctgcttccgctgctctttactccagttactaaagcgggtccgcagagggaagaattcccgcgcgatttgagcctgatttcacctcttgctcaggctgtccgctcctcttcgcgtaccccctcggataaacctgtcgcgcacgtggttgcgaacccgcaagcggaagggcagctgcaatggttaaaccgccgggctaatgcactgctggctaatggagttgagttacgcgacaaccaacttgtcgttccttcggaagggctgtatctgatctattcacaggttctctttaaagggcagggttgcccatcaacccacgtgctcctgacacacacgatcagtcgtatcgcggtatcctatcagacgaaagttaacctcctgtcagcgattaaatcgccgtgtcagagagaaactccagagggtgcggaagctaaaccgtggtatgaacctatttatcttggtggagttttccagttggaaaaaggtgatagactgtcggcagagatcaatcgccctgattacctggatttcgctgagtcgggtcaggtttatttcggaattattgcactgtgaaaataaaacgaaaggctcagtcgaaagactgggcctttcgttttatctgttggttccttatcatctggcgaatcggacccacaagagcactg

SEQ ID NO: 970 - DNA, 1342 bp, Artificial Sequence
  Description of Artificial Sequence: Synthetic polynucleotide
  Ptet-phoA-IFNg
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacaccaccaccacgaggaggtaaaaaatgaagcaatctacgatagcactggcgttgctgccgctgctgttcaccccggttaccaaggcgcaggatccttacgttaaagaagcagagaatctgaaaaaatactttaatgcaggccacagcgatgtggcagataatggcacgttattcctgggcattctgaaaaattggaaagaagaatctgaccggaagatcatgcaatctcagatcgtatcattttatttcaagttgtttaaaaacttcaaggatgaccagtcgattcaaaaatcagtggaaacgatcaaagaagatatgaacgttaagttcttcaactcaaataaaaaaaaacgcgatgatttcgaaaaactgactaattattcggtaactgatttgaatgttcagcgcaaggcgattcatgaattgattcaggttatggcagaactgtcgccagcggcaaaaacgggtaaacgaaaacgttctcagatgttgtttcgtggttgaaaataaaacgaaaggctcagtcgaaagactgggcctttcgttttatctgttggttccttatcatctggcgaatcggacccacaagagcactg

SEQ ID NO: 971-974 - skipped (4 entries)

SEQ ID NO: 975 - DNA, 5100 bp, Artificial Sequence
  Description of Artificial Sequence: Synthetic polynucleotide
  ptet-J43scFv-V5-HIS (
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 976 - DNA, 846 bp, Artificial Sequence
  Description of Artificial Sequence: Synthetic polynucleotide
  J43-Anti-PD1-scFv-V5-HIS
atgcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattga

SEQ ID NO: 977 - DNA, 363 bp, Artificial Sequence
  Description of Artificial Sequence: Synthetic polynucleotide
  scFvHeavy chain
gaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagc

SEQ ID NO: 978 - DNA, 330 bp, Artificial Sequence
  Description of Artificial Sequence: Synthetic polynucleotide
  scFvLight chain
tacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggc

SEQ ID NO: 979 - DNA, 45 bp, Artificial Sequence
  Description of Artificial Sequence: Synthetic oligonucleotide
  scFvLinker
ggtggaggcggctctggcggtggtgggagtggaggcggtggcagt

SEQ ID NO: 980 - protein, 281 aa, Artificial Sequence
  Description of Artificial Sequence: Synthetic polypeptide
  J43-Anti-PD1-scFV polypeptide sequence
MQLEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTRTGHHHHHH

SEQ ID NO: 981 - DNA, 1668 bp, Artificial Sequence
  Description of Artificial Sequence: Synthetic polynucleotide
  Ptet-phoA-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacataattaattcctaatttttgttgacactctatcattgatagagttattttaccactccctatcagtgatagagaaaagtgaaaggaggtaaattatgactagtaaacaatcgaccatcgcattggcgctgcttcctctattgttcacaccggtgacaaaggcagtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccattga

SEQ ID NO: 982 - protein, 313 aa, Artificial Sequence
  Description of Artificial Sequence: Synthetic polypeptide
  phoA-FLAG-J43-scFv-V5-HIS
KQSTIALALLPLLFTPVTKAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 983 - DNA, 1674 bp, Artificial Sequence
  Description of Artificial Sequence: Synthetic polynucleotide
  Ptet-ompF-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtatgatgaagcgtaacatcttagccgttattgtccccgcattgcttgtggccgggacggctaacgcagtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccattga

SEQ ID NO: 984 - protein, 315 aa, Artificial Sequence
  Description of Artificial Sequence: Synthetic polypeptide
  ompF-FLAG-J43-scFv-V5-HIS
MMKRNILAVIVPALLVAGTANAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 985 - DNA, 1668 bp, Artificial Sequence
  Description of Artificial Sequence: Synthetic polynucleotide
  Ptet-PelB-FLAG-J43-scFv-V5-HIS
ttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtaaatatcttcttccaacggctgctgctggtttattgcttcttgccgcccagcctgcgatggctgtcgactataaggatgacgacgacaagcaattgggcggtggcatggaagttcgcctgttggagagcggtggaggacttgtgaagcccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccgccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggactcgattctacgggatccggtcatcatcaccatcaccat

SEQ ID NO: 986 - protein, 314 aa, Artificial Sequence
  Description of Artificial Sequence: Synthetic polypeptide
  PelB-FLAG-J43-scFv-V5-HIS
KYLLPTAAAGLLLLAAQPAMAVDYKDDDDKQLGGGMEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSGGGGSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGKGELNSKLEGKPIPNPLLGLDSTGSGHHHHHH

SEQ ID NO: 987 - DNA, 5708 bp, Artificial Sequence
  Description of Artificial Sequence: Synthetic polynucleotide
  p15A-Kan-ptet-Invasin-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtatggttttccaacccatcagcgaatttttgctgattcgtaacgctgggatgtccatgtattttaacaagatcatttcttttaacatcatttcacgtatcgttatttgcatttttcttatctgtggtatgttcatggccggtgcatctgaaaagtatgatgcaaacgcaccccaacaggtgcagccatactcggtttcatcatcagcgttcgagaatctgcaccccaataacgagatggagtcgagtatcaacccttttagtgcttcggacaccgagcgtaatgcagctatcatcgatcgtgctaacaaggaacaagaaacggaagcagtcaacaaaatgatctccactggcgctcgtttagctgccagcggtcgcgcgtccgatgtggcgcacagtatggtaggggatgcggtcaaccaggagattaaacaatggctgaatcgcttcggcactgctcaagtgaatttaaattttgacaagaacttctcgttaaaggagtcttcgcttgactggttggccccatggtacgattcggcgtcattccttttcttttctcagttgggcatccgtaacaaggacagtcgtaatacacttaaccttggtgttggcattcgcacattagaaaatggttggttgtatggcctgaacaccttttacgacaatgacttaacgggacacaatcaccgtatcgggctgggcgccgaggcgtggactgactacttgcagttagccgcgaatgggtacttccgtcttaatggttggcactcttcccgtgacttcagcgactacaaagaacgccctgctaccgggggagatttgcgtgcgaatgcgtacctgcccgctcttccgcaacttggcgggaagttaatgtatgagcagtatactggggaacgcgtggctctgttcggaaaggacaacctgcagcgcaacccatacgctgtcactgcgggtatcaactatacgccagttccgttgctgacggtcggcgtggatcaacgtatggggaagtcgagtaaacatgaaacgcaatggaatttacaaatgaactatcgcttaggggagagtttccaaagtcagcttagcccttcggcggtcgcagggactcgtttgcttgctgagtcccgctacaacctggttgatcgcaataacaatatcgtactggaataccagaaacaacaagtggttaagctgacgttgagccctgcgaccatcagtggattgcccggacaagtttaccaggtaaatgcccaggtccagggggcctctgcggttcgcgaaattgtctggtcagacgcagaattaatcgctgcaggaggcaccttaacgccactttccactacacaattcaatttagtccttcccccatacaaacgtaccgcccaggtatcgcgcgtaactgatgacttaactgctaatttttattcactgtcggcgttagcagttgaccatcaaggcaaccgtagtaattccttcacattatctgtaacggtgcagcagccgcaactgacgcttaccgcagcggtcattggtgatggggccccagctaatgggaaaaccgcaatcactgtcgagttcacagttgcagattttgaaggcaagccgctggcgggtcaggaggttgtgattacgactaataacggtgctcttcctaataagattactgaaaagactgacgctaacggcgttgcccgcattgcccttacgaacacaaccgatggggtcacggtagttaccgcagaggtcgaggggcaacgccaatccgttgacacgcacttcgttaagggtactatcgcggccgataaaagcacgctggccgcggtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgctaatcagccgtggaattcgcaacgtaaaaaaacccgccccggcgggtttttttataccggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 988 - DNA, 4282 bp, Artificial Sequence
  Description of Artificial Sequence: Synthetic polynucleotide
  p15A-Kan-ptet-LppOmpA-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtaaagcaacaaaacttgtgttaggcgcggttatacttggctccaccctgcttgcaggttgctcgtctaacgcgaagatcgaccagggtatcaatccttacgtcgggtttgaaatgggatacgattggttgggacgtatgccttataagggaagtgttgaaaacggcgcttataaggcgcagggagtacagttaacggccaagcttgggtaccccataacagacgatttagatatttatacccgtttaggaggaatggtttggagagccgacacgaagtctaatgtatatggtaagaaccacgacacgggagtatcccccgtctttgcagggggagtggaatatgctatcacaccagagatcgctacccgtttggaatatcaatggacgaataatataggcgacgcccatacgataggaacgcggcccgacaacggcatccctggggtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgcgaattcggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 989 - DNA, 5864 bp, Artificial Sequence
  Description of Artificial Sequence: Synthetic polynucleotide
  p15A-Kan-ptet-IntiminN-FLAG-J43scFv-V5-HIS
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattatgactagtattacgcatggctgttatacccgtacgcgtcataaacacaagttgaagaaaactctgatcatgttatccgctggacttggactttttttttacgtgaatcagaactctttcgctaatggggaaaattattttaaactgggatcagacagcaaattacttacgcatgactcataccagaatcgtctgttttatacgctgaaaactggtgaaaccgttgcagatttaagtaaaagtcaggacattaacctgtcaactatttggtcacttaataaacacttatattcgagcgaatcggaaatgatgaaagctgcaccggggcaacaaatcatcttgcccctgaagaaattgccctttgaatactccgctttgcccttgctgggctcggctcctctggtagccgccggaggcgttgccggtcacactaataagctgacaaaaatgtcacccgacgtgacgaagagcaacatgacggatgataaggctttaaattacgcagctcagcaagcggcctcgttgggaagtcagttacagagtcgttcgttaaatggtgattatgctaaggataccgcattgggtattgccggcaaccaagcgtcgagccaacttcaggcatggttgcaacattacggcactgctgaagtaaatctgcaatcaggtaataattttgacggtagttccctggatttccttttacctttttacgattcagaaaagatgttggctttcggacaggtgggggcgcgttacatcgattcacgttttaccgctaacttgggggccggtcaacgcttcttcttacctgccaatatgttgggctataatgtatttatcgaccaggacttcagtggtgacaatacacgtctgggaattggtggagagtattggcgcgattactttaagtcatctgtaaatggctattttcgcatgagcggttggcatgaaagttacaacaagaaagactacgatgagcgccccgcgaacgggtttgacatccgttttaatggttatttgccatcttatcccgccttgggagctaaattaatctacgagcaatactatggagataacgtagctttgtttaatagcgacaagttacagtctaatccaggagcggctacagtgggagttaattataccccaatcccactggtcacaatgggaatcgattatcgccacgggactggtaatgaaaacgatttattatactccatgcagtttcgttatcagttcgataagagttggtcgcagcagattgagcctcaatatgttaacgaattacgtaccttgtccggcagtcgctacgatctggtacaacgcaataacaatatcatccttgagtataagaaacaggacattctgtctttgaacattccacatgatattaatggtaccgagcactcaacacaaaaaattcagctgattgtgaaatcaaagtatggactggaccgtatcgtgtgggatgatagcgctctgcgcagtcagggtggacagatccagcactcgggtagccagtctgcccaagactaccaggctatcctgccagcgtatgtccaagggggaagtaacatctacaaagttacagctcgcgcctattaccgcaacggtaattctagtaataatgtgcagttgacaattacggtgctgtccaatgggcaggtcgtcgatcaggtaggtgtgacggattttacagccgataaaacctctgcgaaggcagataacgcggataccatcacatacactgccactgtaaaaaaaaacggtgtcgcgcaggcaaacgttcctgttagcttcaacatcgtgtcgggtacagccacccttggggccaactcggcaaagactgacgcgaatggcaaggctacagtcacgttgaaatcctcgacaccaggacaggtcgttgtgtctgccaagacagcagagatgacctccgcccttaatgcatctgctgttatcttcttcgatcaaacgaaggcatctgtcgactataaggatgacgacgacaagcaattggaagttcgcctgttggagagcggtggtggacttgtgaaacccgagggaagccttaaactttcgtgcgttgctagtgggttcacattttcagactatttcatgtcctgggtccgtcaagccccgggaaaaggacttgaatgggttgcccatatttacaccaagagctataactatgccacatactattctggaagcgttaaaggtcgttttaccatttcgcgtgacgacagccgttctatggtgtatttgcagatgaataaccttcgtacagaagatacggctacttactactgtactcgcgatggatcaggctatcccagtttagatttctggggacagggtactcaggttactgtttcaagcggtggaggcggctctggcggtggtgggagtggaggcggtggcagttacgagctgacgcagccaccctcggcaagtgtaaacgtgggcgaaacggtgaaaattacttgttcgggggatcaactgcccaaatacttcgccgattggtttcatcaacgttccgatcagactattttacaagtgatttatgatgataacaaacgtccgtcaggaatcccagagcgtatcagcggatcgagcagcggaacaacagcaactttgaccatccgcgatgtccgtgccgaagacgagggggactactattgtttctctggatacgtggactcagacagcaagctgtatgtttttggctcaggaacacaactgaccgtactgggcaagggcgagctcaattcgaagcttgaaggtaagcctatccctaaccctctcctcggcctcgattctacgcgtaccggtcatcatcaccatcaccattgagcatgctaatcagccgtggaattcgcaacgtaaaaaaacccgccccggcgggtttttttataccggtctcaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 990 - protein, 607 aa, Artificial Sequence
  Description of Artificial Sequence: Synthetic polypeptide
  Invasin display tag
MVFQPISEFLLIRNAGMSMYFNKIISFNIISRIVICIFLICGMFMAGASEKYDANAPQQVQPYSVSSSAFENLHPNNEMESSINPFSASDTERNAAIIDRANKEQETEAVNKMISTGARLAASGRASDVAHSMVGDAVNQEIKQWLNRFGTAQVNLNFDKNFSLKESSLDWLAPWYDSASFLFFSQLGIRNKDSRNTLNLGVGIRTLENGWLYGLNTFYDNDLTGHNHRIGLGAEAWTDYLQLAANGYFRLNGWHSSRDFSDYKERPATGGDLRANAYLPALPQLGGKLMYEQYTGERVALFGKDNLQRNPYAVTAGINYTPVPLLTVGVDQRMGKSSKHETQWNLQMNYRLGESFQSQLSPSAVAGTRLLAESRYNLVDRNNNIVLEYQKQQVVKLTLSPATISGLPGQVYQVNAQVQGASAVREIVWSDAELIAAGGTLTPLSTTQFNLVLPPYKRTAQVSRVTDDLTANFYSLSALAVDHQGNRSNSFTLSVTVQQPQLTLTAAVIGDGAPANGKTAITVEFTVADFEGKPLAGQEVVITTNNGALPNKITEKTDANGVARIALTNTTDGVTVVTAEVEGQRQSVDTHFVKGTIAADKSTLAAV

SEQ ID NO: 991 - protein, 148 aa, Artificial Sequence
  Description of Artificial Sequence: Synthetic polypeptide
  LppOmpA display tag
KATKLVLGAVILGSTLLAGCSSNAKIDQGINPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGIPG

SEQ ID NO: 992 - protein, 658 aa, Artificial Sequence
  Description of Artificial Sequence: Synthetic polypeptide
  IntiminN display tag
ITHGCYTRTRHKHKLKKTLIMLSAGLGLFFYVNQNSFANGENYFKLGSDSKLLTHDSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPANMLGYNVFIDQDFSGDNTRLGIGGEYWRDYFKSSVNGYFRMSGWHESYNKKDYDERPANGFDIRFNGYLPSYPALGAKLIYEQYYGDNVALFNSDKLQSNPGAATVGVNYTPIPLVTMGIDYRHGTGNENDLLYSMQFRYQFDKSWSQQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYYRNGNSSNNVQLTITVLSNGQVVDQVGVTDFTADKTSAKADNADTITYTATVKKNGVAQANVPVSFNIVSGTATLGANSAKTDANGKATVTLKSSTPGQVVVSAKTAEMTSALNASAVIFFDQTKAS

SEQ ID NO: 993 - DNA, 5121 bp, Artificial Sequence
  Description of Artificial Sequence: Synthetic polynucleotide
  pUC-ptet-B6H12antihCD47scFv-V5-HIS
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattcatatgactagtcaattgggtggtagcgaggtccagctggtggaatctggcggagacttagtaaagccgggaggttcgttgaagttgagttgcgctgctagtgggtttacgtttagcggctatggtatgtcatgggtccgccaaacacccgataaacgtttagagtgggtcgccacgattacgagtggaggcacctacacctattatccggattctgtcaaaggccgctttactatttctcgtgataatgcaaagaacaccttatatttacagatcgactccttgaagtctgaggataccgcaatttatttctgtgcccgttcgttagccggtaatgctatggattattgggggcaaggcacatctgtcacagtctcatccggaggaggcggatcaggtggtggcggttctggcggcggcggatctgacattgtgatgacacaatcacctgcgacactttcggttactccaggagaccgcgttagcttgtcgtgtcgcgcctctcaaaccatcagtgactacttacattggtaccaacagaaatcccatgaatcgccacgcttacttattaagtttgcgtcccaatcaattagtggtattccgtcgcgctttagtggtagcggttctggttctgatttcacattgtcaatcaacagcgtggagccggaggatgttggtgtttactactgccaaaacggtcacggctttccacgtacattcggagggggaacgaagttggaaattaaaggcagcggcgagctcggtggcagtggtaagcctatccctaaccctctcctcggcctcgattctacgggatccggtcatcatcaccatcaccattgagcatgctaatcagccgtggaattcgaattcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 994 - protein, 240 aa, Artificial Sequence
  Description of Artificial Sequence: Synthetic polypeptide
  B6H12-anti-CD47-scFv polypeptide sequence
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSGGGGSGGGGSGGGGSDIVMTQSPATLSVTPGDRVSLSCRASQTISDYLHWYQQKSHESPRLLIKFASQSISGIPSRFSGSGSGSDFTLSINSVEPEDVGVYYCQNGHGFPRTFGGGTKLEIK

SEQ ID NO: 995 - DNA, 5133 bp, Artificial Sequence
  Description of Artificial Sequence: Synthetic polynucleotide
  pUC-ptet-5F9antihCD47scFv-V5-HIS
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaaggaggtaaattcatatgactagtcaattgggtggtagccaggtgcagcttgtgcagagtggcgctgaagtgaagaaaccgggcgcatcagtgaaagtgagctgcaaagcaagcggttataccttcacgaactataacatgcactgggtacgtcaagcacccggccagcgtcttgagtggatgggcaccatttatcctggaaacgacgacacatcctacaaccaaaagtttaaggaccgcgtaactatcactgctgacacttcagcttccacagcatatatggagcttagtagcctgcgtagtgaagacacagcggtctactactgcgcacgtggagggtatcgtgcgatggactactgggggcagggcacacttgtgactgtttcatctggcggtggaggctctggaggggggggtagcggggggggcggtagcgatatcgtaatgactcagtccccactttccttacccgtcacaccgggcgaacctgcatctattagctgtcgttcgtcgcaaagcattgtttactcgaatgggaatacgtacttggggtggtatcttcaaaaaccagggcagtcccctcagttgttgatctacaaggtgtccaaccgctttagtggggtgcctgatcgtttctctggcagtggtagtggtaccgacttcacgcttaaaatttcccgtgtcgaagcagaagacgttggcgtatattactgcttccaaggcagtcatgtgccatacacgttcgggcaaggcaccaaacttgagatcaaaggcagcggcgagctcggtggcagtggtaagcctatccctaaccctctcctcggcctcgattctacgggatccggtcatcatcaccatcaccattgagcatgctaatcagccgtggaattcgaattcggtctcaggaggaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 996 - protein, 244 aa, Artificial Sequence
  Description of Artificial Sequence: Synthetic polypeptide
  5F9-anti-CD47-scFv polypeptide sequence
QVQLVQSGAEVKKPGASVKVSCKASGYTFTNYNMHWVRQAPGQRLEWMGTIYPGNDDTSYNQKFKDRVTITADTSASTAYMELSSLRSEDTAVYYCARGGYRAMDYWGQGTLVTVSSGGGGSGGGGSGGGGSDIVMTQSPLSLPVTPGEPASISCRSSQSIVYSNGNTYLGWYLQKPGQSPQLLIYKVSNRFSGVPDRFSGSGSGTDFTLKISRVEAEDVGVYYCFQGSHVPYTFGQGTKLEIK

SEQ ID NO: 997 - DNA, 2555 bp, Artificial Sequence
  Description of Artificial Sequence: Synthetic polynucleotide
  Biosafety Plasmid System Component  dap A
actcttcctttttcaatattattgaagcatttatcagggttattgtctcatgagcggatacatatttgaatgtatttagaaaaataaacaaataggggaattaaaaaaaagcccgctcattaggcgggctactacctaggccgcggccgcgcgaattcgagctcggtacccggggatcctctagagtcgacctgcaggcatgcaagcttgcggccgcgtcgtgactgggaaaaccctggcgactagtcttggactcctgttgatagatccagtaatgacctcagaactccatctggatttgttcagaacgctcggttgccgccgggcgttttttattggtgagaatccaggggtccccaataattacgatttaaatcacagcaaacaccacgtcggccctatcagctgcgtgctttctatgagtcgttgctgcataacttgacaattaacatccggctcgtagggtttgtggagggcccaagttcacttaaaaaggagatcaacaatgaaagcaattttcgtactgaaacatcttaatcatgctggggagggtttctaatgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggccgtgagacggtcagagcggcgcttaaacatgccggtttgctgtaagacttttgtcaggttcctactgtgacgactaccaccgatagactggagtgttgctgcgaaaaaaccccgccgaagcggggttttttgcgagaagtcaccacgattgtgctttacacggagtagtcggcagttccttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccatctagtataactattgtttctctagtaacatttattgtacaacacgagcccatttttgtcaaataaattttaaattatatcaacgttaataagacgttgtcaataaaattattttgacaaaattggccggccggcgcgccgatctgaagatcagcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcctttaaggtttaacggttgtggacaacaagccagggatgtaacgcactgagaagcccttagagcctctcaaagcaattttgagtgacacaggaacacttaacggctgacatggggcgcgcccagctgtctagggcggcggatttgtcctactcaggagagcgttcaccgacaaacaacagataaaacgaaaggcccagtctttcgactgagcctttcgttttatttgatgcct

SEQ ID NO: 998 - DNA, 2472 bp, Artificial Sequence
  Description of Artificial Sequence: Synthetic polynucleotide
  Biosafety Plasmid System Component  ThyA
actcttcctttttcaatattattgaagcatttatcagggttattgtctcatgagcggatacatatttgaatgtatttagaaaaataaacaaataggggaattaaaaaaaagcccgctcattaggcgggctactacctaggccgcggccgcgcgaattcgagctcggtacccggggatcctctagagtcgacctgcaggcatgcaagcttgcggccgcgtcgtgactgggaaaaccctggcgactagtcttggactcctgttgatagatccagtaatgacctcagaactccatctggatttgttcagaacgctcggttgccgccgggcgttttttattggtgagaatccaggggtccccaataattacgatttaaatcacagcaaacaccacgtcggccctatcagctgcgtgctttctatgagtcgttgctgcataacttgacaattaatcatccggctcgtagggtttgtggagggcccaagttcacttaaaaaggagatcaacaatgaaagcaattttcgtactgaaacatcttaatcatgctggggagggtttctaatgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttcttcagggcgacactaacattgcttatctacacgaaaacaatgtcaccatctgggacgaatgggccgatgaaaacggcgacctcgggccagtgtatggtaaacagtggcgtgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaagacttttgtcaggttcctactgtgacgactaccaccgatagactggagtgttgctgcgaaaaaaccccgccgaagcggggttttttgcgagaagtcaccacgattgtgctttacacggagtagtcggcagttccttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccatctagtataactattgtttctctagtaacatttattgtacaacacgagcccatttttgtcaaataaattttaaattatatcaacgttaataagacgttgtcaataaaattattttgacaaaattggccggccggcgcgccgatctgaagatcagcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttcacgtactaagctctcatgtttgaacaataaaattaatataaatcagcaacttaaatagcctctaaggttttaagttttataagaaaaaaaagaatatataaggcttttaaagcctttaaggtttaacggttgtggacaacaagccagggatgtaacgcactgagaagcccttagagcctctcaaagcaattttgagtgacacaggaacacttaacggctgacatggggcgcgcccagctgtctagggcggcggatttgtcctactcaggagagcgttcaccgacaaacaacagataaaacgaaaggcccagtctttcgactgagcctttcgttttatttgatgcct

SEQ ID NO: 999 - DNA, 333 bp, Artificial Sequence
  Description of Artificial Sequence: Synthetic polynucleotide
  Kid toxin (reverse orientation)
ttaagtcagaatagtggacaggcggccaagaacttcgttcatgatagtctccggaacccgttcgagtcgttttccgccccgtgctttcatatcaattgtccggggttgatcgcaacgtacaacacctgtggtacgtatgccaacaccatccaacgacaccgcaaagccggcagtgcgggcaaaattgcctccgctggttacgggcacaacaacaggcaggcgggtcacgcgattaaaggccgccggtgtgacaatcagcaccggccgcgttccctgctgctcatgacctgcggtaggatcaagcgagacaagccagatttcccctctttccat

SEQ ID NO: 1000 - DNA, 879 bp, Artificial Sequence
  Description of Artificial Sequence: Synthetic polynucleotide
  dapA
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggccgtgagacggtcagagcggcgcttaaacatgccggtttgctgtaa

SEQ ID NO: 1001 - DNA, 795 bp, Artificial Sequence
  Description of Artificial Sequence: Synthetic polynucleotide
  thyA
atgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttcttcagggcgacactaacattgcttatctacacgaaaacaatgtcaccatctgggacgaatgggccgatgaaaacggcgacctcgggccagtgtatggtaaacagtggcgtgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaa

SEQ ID NO: 1002 - protein, 110 aa, Artificial Sequence
  Description of Artificial Sequence: Synthetic polypeptide
  Kid toxin polypeptide
MERGEIWLVSLDPTAGHEQQGTRPVLIVTPAAFNRVTRLPVVVPVTSGGNFARTAGFAVSLDGVGIRTTGVVRCDQPRTIDMKARGGKRLERVPETIMNEVLGRLSTILT

SEQ ID NO: 1003 - protein, 292 aa, Artificial Sequence
  Description of Artificial Sequence: Synthetic polypeptide
  dapA polypeptide
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 1004 - protein, 264 aa, Artificial Sequence
  Description of Artificial Sequence: Synthetic polypeptide
  ThyA polypeptide
MKQYLELMQKVLDEGTQKNDRTGTGTLSIFGHQMRFNLQDGFPLVTTKRCHLRSIIHELLWFLQGDTNIAYLHENNVTIWDEWADENGDLGPVYGKQWRAWPTPDGRHIDQITTVLNQLKNDPDSRRIIVSAWNVGELDKMALAPCHAFFQFYVADGKLSCQLYQRSCDVFLGLPFNIASYALLVHMMAQQCDLEVGDFVWTGGDTHLYSNHMDQTHLQLSREPRPLPKLIIKRKPESIFDYRFEDFEIEGYDPHPGIKAPVAI

SEQ ID NO: 1005 - DNA, 1490 bp, Artificial Sequence
  Description of Artificial Sequence: Synthetic polynucleotide
  Biosafety Chromosomal Construct -  low copy Rep (Pi) and Kis antitoxin (as shown in Fig. 76C)
ttgacggctagctcagtcctaggtacagtgctagcggatctgctggaacaggtggtgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtgaggatctccaggcatcaaataaaacgaaaggctcagtcgaaagactgggcctttcgttttatctgttgtttgtcggtgaacgctctctactagagtcacactggctcaccttcgggtgggcctttctgcgtttatacccgggaaaaagagtattgacttaaagtctaacctataggtataatgtgtggagaccagaggtaaggaggtaacaaccatgcgagtgttgaagaaacatcttaatcatgctaaggaggttttctaatgcataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1006 - DNA, 1490 bp, Artificial Sequence
  Description of Artificial Sequence: Synthetic polynucleotide
  Biosafety Chromosomal Construct -  medium copy Rep (Pi) and Kis antitoxin (as shown in Fig. 76D)
ttgacggctagctcagtcctaggtacagtgctagcggatcttccggaagactaggtgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtgaggatctccaggcatcaaataaaacgaaaggctcagtcgaaagactgggcctttcgttttatctgttgtttgtcggtgaacgctctctactagagtcacactggctcaccttcgggtgggcctttctgcgtttatacccgggaaaaagagtattgacttaaagtctaacctataggtataatgtgtggagaccagaggtaaggaggtaacaaccatgcgagtgttgaagaaacatcttaatcatgctaaggaggttttctaatgcataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1007 - DNA, 917 bp, Artificial Sequence
  Description of Artificial Sequence: Synthetic polynucleotide
  Rep (Pi)
tgagactcaaggtcatgatggacgtgaacaaaaaaacgaaaattcgccaccgaaacgagctaaatcacaccctggctcaacttcctttgcccgcaaagcgagtgatgtatatggcgcttgctcccattgatagcaaagaacctcttgaacgagggcgagttttcaaaattagggctgaagaccttgcagcgctcgccaaaatcaccccatcgcttgcttatcgacaattaaaagagggtggtaaattacttggtgccagcaaaatttcgctaagaggggatgatatcattgctttagctaaagagcttaacctgctctttactgctaaaaactcccctgaagagttagaccttaacattattgagtggatagcttattcaaatgatgaaggatacttgtctttaaaattcaccagaaccatagaaccatatatctctagccttattgggaaaaaaaataaattcacaacgcaattgttaacggcaagcttacgcttaagtagccagtattcatcttctctttatcaacttatcaggaagcattactctaattttaagaagaaaaattattttattatttccgttgatgagttaaaggaagagttaatagcttatacttttgataaagatggaaatattgagtacaaataccctgactttcctatttttaaaagggatgtgttaaataaagccattgctgaaattaaaaagaaaacagaaatatcgtttgttggcttcactgttcatgaaaaagaaggaagaaaaattagtaagctgaagttcgaatttgtcgttgatgaagatgaattttctggcgataaagatgatgaagctttttttatgaatttatctgaagctgatgcagcttttctcaaggtatttgatgaaaccgtacctcccaaaaaagctaaggggtga

SEQ ID NO: 1008 - DNA, 255 bp, Artificial Sequence
  Description of Artificial Sequence: Synthetic polynucleotide
  Kis antitoxin
cataccacccgactgaagagggttggcggctcagttatgctgaccgtcccaccggcactgctgaatgcgctgtctctgggcacagataatgaagttggcatggtcattgataatggccggctgattgttgagccgtacagacgcccgcaatattcactggctgagctactggcacagtgtgatccgaatgctgaaatatcagctgaagaacgagaatggctggatgcaccggcgactggtcaggaggaaatctga

SEQ ID NO: 1009 - DNA, 14 bp, Artificial Sequence
  Description of Artificial Sequence: Synthetic oligonucleotide
  RBS (low copy)
gctggaacaggtgg

SEQ ID NO: 1010 - DNA, 14 bp, Artificial Sequence
  Description of Artificial Sequence: Synthetic oligonucleotide
  RBS (medium copy)
tccggaagactagg

SEQ ID NO: 1011 - DNA, 60 bp, Artificial Sequence
  Description of Artificial Sequence: Synthetic oligonucleotide
  SR36
tagaactgatgcaaaaagtgctcgacgaaggcacacagatgtgtaggctggagctgcttc

SEQ ID NO: 1012 - DNA, 60 bp, Artificial Sequence
  Description of Artificial Sequence: Synthetic oligonucleotide
  SR38
gtttcgtaattagatagccaccggcgctttaatgcccggacatatgaatatcctccttag

SEQ ID NO: 1013 - DNA, 52 bp, Artificial Sequence
  Description of Artificial Sequence: Synthetic oligonucleotide
  SR33
caacacgtttcctgaggaaccatgaaacagtatttagaactgatgcaaaaag

SEQ ID NO: 1014 - DNA, 36 bp, Artificial Sequence
  Description of Artificial Sequence: Synthetic oligonucleotide
  SR43
atatcgtcgcagcccacagcaacacgtttcctgagg

SEQ ID NO: 1015 - DNA, 47 bp, Artificial Sequence
  Description of Artificial Sequence: Synthetic oligonucleotide
  SR44
aagaatttaacggagggcaaaaaaaaccgacgcacactggcgtcggc

SEQ ID NO: 1016 - DNA, 967 bp, Artificial Sequence
  Description of Artificial Sequence: Synthetic polynucleotide
  Wild-type clbA
caaatatcacataatcttaacatatcaataaacacagtaaagtttcatgtgaaaaacatcaaacataaaatacaagctcggaatacgaatcacgctatacacattgctaacaggaatgagattatctaaatgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattgaatcgccacggataatctagacacttctgagccgtcgataatattgattttcatattccgtcggtggtgtaagtatcccgcataatcgtgccattcacatttag

SEQ ID NO: 1017 - DNA, 424 bp, Artificial Sequence
  Description of Artificial Sequence: Synthetic polynucleotide
  clbA knockout
ggatggggggaaacatggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatctaaatgaggattgatgtgtaggctggagctgcttcgaagttcctatactttctagagaataggaacttcggaataggaacttcggaataggaactaaggaggatattcatatgtcgtcaaatgggcagaattgaatcgccacggataatctagacacttctgagccgtcgataatattgattttcatattccgtcggtgg

SEQ ID NO: 1018 - DNA, 28 bp, Artificial Sequence
  Description of Artificial Sequence: Synthetic oligonucleotide
  Master Sequence
  modified_base (13)..(15): a, c, g or t
  modified_base (18)..(20): a, c, g or t
tctagagaaagannngannnactagatg

SEQ ID NO: 1019 - DNA, 28 bp, Artificial Sequence
  Description of Artificial Sequence: Synthetic oligonucleotide
  BBa_J61100
tctagagaaagaggggacaaactagatg

SEQ ID NO: 1020 - DNA, 28 bp, Artificial Sequence
  Description of Artificial Sequence: Synthetic oligonucleotide
  BBa_J61101
tctagagaaagacaggacccactagatg

SEQ ID NO: 1021 - DNA, 28 bp, Artificial Sequence
  Description of Artificial Sequence: Synthetic oligonucleotide
  BBa_J61102
tctagagaaagatccgatgtactagatg

SEQ ID NO: 1022 - DNA, 28 bp, Artificial Sequence
  Description of Artificial Sequence: Synthetic oligonucleotide
  BBa_J61103
tctagagaaagattagacaaactagatg

SEQ ID NO: 1023 - DNA, 28 bp, Artificial Sequence
  Description of Artificial Sequence: Synthetic oligonucleotide
  BBa_J61104
tctagagaaagaagggacagactagatg

SEQ ID NO: 1024 - DNA, 28 bp, Artificial Sequence
  Description of Artificial Sequence: Synthetic oligonucleotide
  BBa_J61105
tctagagaaagacatgacgtactagatg

SEQ ID NO: 1025 - DNA, 28 bp, Artificial Sequence
  Description of Artificial Sequence: Synthetic oligonucleotide
  BBa_J61106
tctagagaaagataggagacactagatg

SEQ ID NO: 1026 - DNA, 28 bp, Artificial Sequence
  Description of Artificial Sequence: Synthetic oligonucleotide
  BBa_J61107
tctagagaaagaagagactcactagatg

SEQ ID NO: 1027 - DNA, 28 bp, Artificial Sequence
  Description of Artificial Sequence: Synthetic oligonucleotide
  BBa_J61108
tctagagaaagacgagatatactagatg

SEQ ID NO: 1028 - DNA, 28 bp, Artificial Sequence
  Description of Artificial Sequence: Synthetic oligonucleotide
  BBa_J61109
tctagagaaagactggagacactagatg

SEQ ID NO: 1029 - DNA, 28 bp, Artificial Sequence
  Description of Artificial Sequence: Synthetic oligonucleotide
  BBa_J61110
tctagagaaagaggcgaattactagatg

SEQ ID NO: 1030 - DNA, 28 bp, Artificial Sequence
  Description of Artificial Sequence: Synthetic oligonucleotide
  BBa_J61111
tctagagaaagaggcgatacactagatg

SEQ ID NO: 1031 - DNA, 28 bp, Artificial Sequence
  Description of Artificial Sequence: Synthetic oligonucleotide
  BBa_J61112
tctagagaaagaggtgacatactagatg

SEQ ID NO: 1032 - DNA, 28 bp, Artificial Sequence
  Description of Artificial Sequence: Synthetic oligonucleotide
  BBa_J61113
tctagagaaagagtggaaaaactagatg

SEQ ID NO: 1033 - DNA, 28 bp, Artificial Sequence
  Description of Artificial Sequence: Synthetic oligonucleotide
  BBa_J61114
tctagagaaagatgagaagaactagatg

SEQ ID NO: 1034 - DNA, 28 bp, Artificial Sequence
  Description of Artificial Sequence: Synthetic oligonucleotide
  BBa_J61115
tctagagaaagaagggatacactagatg

SEQ ID NO: 1035 - DNA, 28 bp, Artificial Sequence
  Description of Artificial Sequence: Synthetic oligonucleotide
  BBa_J61116
tctagagaaagacatgaggcactagatg

SEQ ID NO: 1036 - DNA, 28 bp, Artificial Sequence
  Description of Artificial Sequence: Synthetic oligonucleotide
  BBa_J61117
tctagagaaagacatgagttactagatg

SEQ ID NO: 1037 - DNA, 28 bp, Artificial Sequence
  Description of Artificial Sequence: Synthetic oligonucleotide
  BBa_J61118
tctagagaaagagacgaatcactagatg

SEQ ID NO: 1038 - DNA, 28 bp, Artificial Sequence
  Description of Artificial Sequence: Synthetic oligonucleotide
  BBa_J61119
tctagagaaagatttgatatactagatg

SEQ ID NO: 1039 - DNA, 28 bp, Artificial Sequence
  Description of Artificial Sequence: Synthetic oligonucleotide
  BBa_J61120
tctagagaaagacgcgagaaactagatg

SEQ ID NO: 1040 - DNA, 28 bp, Artificial Sequence
  Description of Artificial Sequence: Synthetic oligonucleotide
  BBa_J61121
tctagagaaagagacgagtcactagatg

SEQ ID NO: 1041 - DNA, 28 bp, Artificial Sequence
  Description of Artificial Sequence: Synthetic oligonucleotide
  BBa_J61122
tctagagaaagagaggagccactagatg

SEQ ID NO: 1042 - DNA, 28 bp, Artificial Sequence
  Description of Artificial Sequence: Synthetic oligonucleotide
  BBa_J61123
tctagagaaagagatgactaactagatg

SEQ ID NO: 1043 - DNA, 28 bp, Artificial Sequence
  Description of Artificial Sequence: Synthetic oligonucleotide
  BBa_J61124
tctagagaaagagccgacatactagatg

SEQ ID NO: 1044 - DNA, 28 bp, Artificial Sequence
  Description of Artificial Sequence: Synthetic oligonucleotide
  BBa_J61125
tctagagaaagagccgagttactagatg

SEQ ID NO: 1045 - DNA, 28 bp, Artificial Sequence
  Description of Artificial Sequence: Synthetic oligonucleotide
  BBa_J61126
tctagagaaagaggtgactcactagatg

SEQ ID NO: 1046 - DNA, 28 bp, Artificial Sequence
  Description of Artificial Sequence: Synthetic oligonucleotide
  BBa_J61127
tctagagaaagagtggaactactagatg

SEQ ID NO: 1047 - DNA, 28 bp, Artificial Sequence
  Description of Artificial Sequence: Synthetic oligonucleotide
  BBa_J61128
tctagagaaagataggactcactagatg

SEQ ID NO: 1048 - DNA, 28 bp, Artificial Sequence
  Description of Artificial Sequence: Synthetic oligonucleotide
  BBa_J61129
tctagagaaagattggacgtactagatg

SEQ ID NO: 1049 - DNA, 28 bp, Artificial Sequence
  Description of Artificial Sequence: Synthetic oligonucleotide
  BBa_J61130
tctagagaaagaaacgacatactagatg

SEQ ID NO: 1050 - DNA, 28 bp, Artificial Sequence
  Description of Artificial Sequence: Synthetic oligonucleotide
  BBa_J61131
tctagagaaagaaccgaattactagatg

SEQ ID NO: 1051 - protein, 26 aa, Artificial Sequence
  Description of Artificial Sequence: Synthetic peptide
  polypeptide linker
SSADDAKKDAAKKDDAKKDDAKKDAS

SEQ ID NO: 1052 - protein, 15 aa, Artificial Sequence
  Description of Artificial Sequence: Synthetic peptide
  polypeptide linker
GGGGSGGGGSGGGGS

SEQ ID NO: 1053 - protein, 197 aa, Artificial Sequence
  Description of Artificial Sequence: Synthetic polypeptide
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1054 - protein, 306 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 1055 - protein, 197 aa, Artificial Sequence; identical to SEQ ID NO: 1053
  Description of Artificial Sequence: Synthetic polypeptide

SEQ ID NO: 1056 - protein, 313 aa, Artificial Sequence
  Description of Artificial Sequence: Synthetic polypeptide
MWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 1057 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1058 - protein, 127 aa, Artificial Sequence [sequence omitted]

SEQ ID NO: 1059 - protein, 177 aa, Artificial Sequence
  Description of Artificial Sequence: Synthetic polypeptide
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 1060 - protein, 138 aa, Artificial Sequence
  Description of Artificial Sequence: Synthetic polypeptide
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 1061 - protein, 73 aa, Artificial Sequence
  Description of Artificial Sequence: Synthetic polypeptide
VPLSRTVRCTCISISNQPVNPRSLEKLEIIPASQFCPRVEIIATMKKKGEKRCLNPESKAIKNLLKAVSKERS

SEQ ID NO: 1062 - protein, 125 aa, Artificial Sequence
  Description of Artificial Sequence: Synthetic polypeptide
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 1063 - DNA, 594 bp, Artificial Sequence
  Description of Artificial Sequence: Synthetic polynucleotide
aggaacctgcctgtggcaacaccagaccctgggatgttcccttgcttacatcattcccagaacctgttgcgtgcggtgtctaacatgctgcagaaagccaggcagacgctggaattctacccatgcacttccgaagagatagatcatgaagacattacgaaagacaaaacctcaacggttgaagcatgcttacctctggaattgactaagaatgaatcgtgcttaaactcaagagagaccagtttcatcactaatggctcttgcttagcgtcgcgcaagaccagcttcatgatggcgctctgcctaagtagcatctacgaggacctcaaaatgtaccaagttgaatttaaaactatgaatgccaaacttctaatggacccaaaaagacagatatttttagatcagaatatgcttgcggttattgacgaactcatgcaggcattgaattttaattccgagacggtgccacaaaaaagttctttggaggagccggacttttacaagacaaaaatcaagctgtgcatacttcttcacgcattcagaatacgggccgttacgatcgatcgcgtcatgtcgtatcttaatgcgagctga

SEQ ID NO: 1064 - DNA, 924 bp, Artificial Sequence
  Description of Artificial Sequence: Synthetic polynucleotide
atctgggaactgaaaaaagatgtttatgtagttgaactggattggtacccggatgcacccggtgagatggtggttttgacctgcgacacgccggaagaagatggcataacgtggaccctggatcaaagctctgaagttctgggttcaggtaagacattgacgatccaagtaaaagaatttggcgacgcaggtcagtacacctgccacaaaggtggcgaagttctgtcgcactcactcctgctcctgcacaaaaaagaggatggcatctggagtactgatatcctaaaggatcaaaaagaacctaaaaacaaaacgttcttgcgctgtgaagcgaagaactatagtggtcgctttacgtgctggtggttgactaccatttccaccgatttgaccttttctgttaagagttcgcgcggctcgtcagatccgcagggcgttacttgcggtgcggcgacgctgtcagctgagagagttcgtggggacaacaaagagtacgaatatagtgtagaatgtcaagaggattcggcgtgcccggcagcagaggagtctctccccattgaagttatggtggacgcagtgcataaactgaaatatgagaattacacatcaagcttttttattcgcgatatcatcaaaccggatcctccaaaaaatctgcaactaaagcccctgaaaaattcgcgccaagttgaggtgagctgggaatatccggatacttggtcgacaccgcattcttatttctcactgaccttctgcgttcaggttcaaggtaaatcaaaacgagaaaaaaaggatcgcgtctttaccgacaaaacgtctgctactgtaatctgccgcaagaatgcgtcaatttctgtacgtgcgcaagatcgctactactctagtagttggtctgaatgggcttcagtgccatgctcctgatga

SEQ ID NO: 1065 - DNA, 594 bp, Artificial Sequence
  Description of Artificial Sequence: Synthetic polynucleotide
cgtaaccttccggtggccacgccagatccgggcatgttcccgtgcttacaccattcccagaatctgctgcgcgctgtgagtaatatgctgcagaaggcgagacaaactttggaattttacccgtgcacttcggaggagattgaccatgaggatatcacaaaagacaaaaccagtacagtggaagcctgcctgccccttgaactgactaaaaatgagagttgtttaaattcacgcgaaaccagcttcattactaacggaagctgcttagcatcgcggaaaaccagttttatgatggccctttgcctttcatctatttacgaggaccttaaaatgtatcaagttgaatttaagactatgaacgcgaaactgctaatggatcccaagcgacaaatctttcttgatcaaaatatgttggctgttattgatgaactgatgcaagccctgaattttaactcagaaaccgtacctcagaaatcgagtttagaagaacccgatttctacaaaactaaaatcaagttgtgtatccttttacatgccttccggattcgggccgtcactattgatcgcgtgatgtcgtacttgaatgcctcctaa

SEQ ID NO: 1066 - DNA, 942 bp, Artificial Sequence
  Description of Artificial Sequence: Synthetic polynucleotide
atgtgggaattggaaaaagacgtgtatgttgttgaagttgactggactccggacgcgcctggtgaaactgttaatctgacttgtgatacaccggaggaagatgatataacttggactagcgatcaacgacacggcgtaatcggctctggtaagactttgaccattactgtgaaggaattcttggatgcggggcaatatacgtgtcataaaggcggcgagacgctgtcacactctcacctgttgttacataaaaaagagaatggtatatggtctacggagatcttgaaaaactttaaaaacaaaacttttttgaagtgtgaggctccaaactattctggtcgctttacctgtagttggttggtgcaacgtaacatggatctcaaatttaacataaagtcgtcttcgtcttctcccgatagccgagcggttacctgtggcatggctagtttgtcggcggagaaggtgaccttggatcaacgtgattatgaaaaatatagcgtttcgtgccaagaggacgttacgtgccctaccgctgaagagactttgccgattgaattggcactggaagcacgacaacaaaataaatacgagaattactcaactagtttcttcatccgagatatcataaaaccggaccccccgaagaatctgcaaatgaaaccgcttaaaaattcacaggtagaggtttcgtgggagtacccggatagttggtctacgcctcattcgtattttagcctgaaatttttcgttcgaatacagcgaaaaaaagagaagatgaaagaaactgaagaagggtgtaaccaaaaaggtgcatttctggtggagaaaactagcaccgaggttcaatgcaaaggcggtaacgtgtgcgtacaagctcaagaccgttattataacagtagctgttctaaatgggcttgcgtgccctgccgcgtgagatcatga

SEQ ID NO: 1067 - DNA, 345 bp, Artificial Sequence
  Description of Artificial Sequence: Synthetic polynucleotide
aattgggttaatgttatatctgatttgaaaaaaatagaggatctgattcaatcaatgcacatagatgcgactctgtatactgagagcgatgtgcacccgagttgcaaagttactgctatgaaatgttttctgctggagctgcaagttatctctctggagagtggtgatgcgtctattcacgatactgttgagaatctgattattctggctaataactcgctgtcaagtaatgggaatgttacggaatctggctgtaaggagtgtgaagaattagaagaaaaaaatattaaagagtttctgcagagttttgtgcacattgttcagatgtttatcaatactagctga

SEQ ID NO: 1068 - DNA, 384 bp, Artificial Sequence
  Description of Artificial Sequence: Synthetic polynucleotide
gcaccggcccgcagcccatcaccgtcaactcaaccttgggaacatgtaaatgctattcaagaagctcgccgcctgttgaatttgagtcgcgatactgcagcagagatgaatgagactgtagaggtgatttcagaaatgtttgacctgcaggagccgacttgtttgcaaactcgcctggagctgtacaaacaaggcctgcgtggctcgctgactaaactgaaaggtcctctgacgatgatggcttctcattataaacaacactgcccgcctactccggagacgtcttgcgcgacccagataattacttttgaatcttttaaagagaatctgaaagactttctgctggttatcccgtttgattgttgggaaccggttcaagaataa

SEQ ID NO: 1069 - DNA, 534 bp, Artificial Sequence
  Description of Artificial Sequence: Synthetic polynucleotide
ggtccgcagagggaagaattcccgcgcgatttgagcctgatttcacctcttgctcaggctgtccgctcctcttcgcgtaccccctcggataaacctgtcgcgcacgtggttgcgaacccgcaagcggaagggcagctgcaatggttaaaccgccgggctaatgcactgctggctaatggagttgagttacgcgacaaccaacttgtcgttccttcggaagggctgtatctgatctattcacaggttctctttaaagggcagggttgcccatcaacccacgtgctcctgacacacacgatcagtcgtatcgcggtatcctatcagacgaaagttaacctcctgtcagcgattaaatcgccgtgtcagagagaaactccagagggtgcggaagctaaaccgtggtatgaacctatttatcttggtggagttttccagttggaaaaaggtgatagactgtcggcagagatcaatcgccctgattacctggatttcgctgagtcgggtcaggtttatttcggaattattgcactgtga

SEQ ID NO: 1070 - DNA, 417 bp, Artificial Sequence
  Description of Artificial Sequence: Synthetic polynucleotide
caggatccttacgttaaagaagcagagaatctgaaaaaatactttaatgcaggccacagcgatgtggcagataatggcacgttattcctgggcattctgaaaaattggaaagaagaatctgaccggaagatcatgcaatctcagatcgtatcattttatttcaagttgtttaaaaacttcaaggatgaccagtcgattcaaaaatcagtggaaacgatcaaagaagatatgaacgttaagttcttcaactcaaataaaaaaaaacgcgatgatttcgaaaaactgactaattattcggtaactgatttgaatgttcagcgcaaggcgattcatgaattgattcaggttatggcagaactgtcgccagcggcaaaaacgggtaaacgaaaacgttctcagatgttgtttcgtggttga

SEQ ID NO: 1071 - DNA, 222 bp, Artificial Sequence
  Description of Artificial Sequence: Synthetic polynucleotide
gtgcccctgagccgcaccgtgcgttgtacgtgtatctccatctcaaaccagccggtaaacccgcgtagtttagaaaaactggagattatcccagccagccagttttgcccgcgcgttgagattattgcgaccatgaagaaaaaaggggaaaaacgttgccttaatccagaaagtaaggctatcaaaaacctgttgaaagctgtctcgaaagagcgttcctaa

SEQ ID NO: 1072 - protein, 95 aa, Artificial Sequence
  Description of Artificial Sequence: Synthetic polypeptide
MMKRNILAVIVPALLVAGTANAVPLSRTVRCTCISISNQPVNPRSLEKLEIIPASQFCPRVEIIATMKKKGEKRCLNPESKAIKNLLKAVSKERS

SEQ ID NO: 1073 - protein, 94 aa, Artificial Sequence
  Description of Artificial Sequence: Synthetic polypeptide
MKQSTIALALLPLLFTPVTKAVPLSRTVRCTCISISNQPVNPRSLEKLEIIPASQFCPRVEIIATMKKKGEKRCLNPESKAIKNLLKAVSKERS

SEQ ID NO: 1074 - protein, 112 aa, Artificial Sequence
  Description of Artificial Sequence: Synthetic polypeptide
MNNNDLFQASRRRFLAQLGGLTVAGMLGPSLLTPRRATAVPLSRTVRCTCISISNQPVNPRSLEKLEIIPASQFCPRVEIIATMKKKGEKRCLNPESKAIKNLLKAVSKERS

SEQ ID NO: 1075 - protein, 125 aa, Artificial Sequence
  Description of Artificial Sequence: Synthetic polypeptide
MMKRNILAVIVPALLVAGTANATPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 1076 - protein, 124 aa, Artificial Sequence
  Description of Artificial Sequence: Synthetic polypeptide
MKQSTIALALLPLLFTPVTKATPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 1077 - protein, 142 aa, Artificial Sequence
  Description of Artificial Sequence: Synthetic polypeptide
MNNNDLFQASRRRFLAQLGGLTVAGMLGPSLLTPRRATATPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 1078 - protein, 126 aa, Artificial Sequence
  Description of Artificial Sequence: Synthetic polypeptide
MKQSTIALALLPLLFTPVTKATLVIRNARCSCISTSRGTIHYKSLKDLKQFAPSPNCNKTEIIATLKNGDQTCLDPDSANVKKLMKEWEKKISQKKKQKRGKKHQKNMKNRKPKTPQSRRRSRKTT

SEQ ID NO: 1079 - protein, 127 aa, Artificial Sequence
  Description of Artificial Sequence: Synthetic polypeptide
MMKRNILAVIVPALLVAGTANATLVIRNARCSCISTSRGTIHYKSLKDLKQFAPSPNCNKTEIIATLKNGDQTCLDPDSANVKKLMKEWEKKISQKKKQKRGKKHQKNMKNRKPKTPQSRRRSRKTT

SEQ ID NO: 1080 - protein, 144 aa, Artificial Sequence
  Description of Artificial Sequence: Synthetic polypeptide
MNNNDLFQASRRRFLAQLGGLTVAGMLGPSLLTPRRATATLVIRNARCSCISTSRGTIHYKSLKDLKQFAPSPNCNKTEIIATLKNGDQTCLDPDSANVKKLMKEWEKKISQKKKQKRGKKHQKNMKNRKPKTPQSRRRSRKTT

SEQ ID NO: 1081 - DNA, 285 bp, Artificial Sequence
  Description of Artificial Sequence: Synthetic polynucleotide
atgaagcagagcaccatcgcgcttgccctgctgccgttgcttttcacgcctgtcaccaaggctgtgcccctgagccgcaccgtgcgttgtacgtgtatctccatctcaaaccagccggtaaacccgcgtagtttagaaaaactggagattatcccagccagccagttttgcccgcgcgttgagattattgcgaccatgaagaaaaaaggggaaaaacgttgccttaatccagaaagtaaggctatcaaaaacctgttgaaagctgtctcgaaagagcgttcctaa

SEQ ID NO: 1082 - DNA, 297 bp, Artificial Sequence
  Description of Artificial Sequence: Synthetic polynucleotide
atgaagcagagcaccatcgcgcttgccctgctgccgttgcttttcacgcctgtcaccaaggctatcccactggctcgcacagtccgctgtaattgcatccacatcgatgacggtcctgtgcgtatgcgtgcaatcggtaaacttgaaattatccctgcctccttatcgtgtccccgcgtagagattatcgccacgatgaagaaaaacgatgaacagcgttgtcttaacccagagagcaaaactatcaaaaacctgatgaaggcttttagtcaaaagcgcagtaagcgcgcaccataa

SEQ ID NO: 1083 - DNA, 375 bp, Artificial Sequence
  Description of Artificial Sequence: Synthetic polynucleotide
atgaagcagagcaccatcgcgcttgccctgctgccgttgcttttcacgcctgtcaccaaggctacacccgtagtgcgtaaagggcgctgcagttgcatctcgactaaccaggggacaatccacctgcagtcgctgaaagatttgaagcagtttgcaccgagccctagttgtgaaaaaatcgagatcatcgctacattaaagaacggcgtccaaacatgtcttaaccccgactcagcagatgttaaagaacttattaagaaatgggagaagcaggtaagtcagaaaaagaaacagaaaaatggcaagaaacatcagaaaaagaaagtcttaaaggttcgtaaatcgcagcgttctcgtcaaaagaagacgacgtaa

SEQ ID NO: 1084 - DNA, 381 bp, Artificial Sequence
  Description of Artificial Sequence: Synthetic polynucleotide
atgaagcagagcaccatcgcgcttgccctgctgccgttgcttttcacgcctgtcaccaaggctacgctggtgatccgtaacgcccgctgttcatgcatcagcacttctcgtggaaccatccactataaatcattaaaggacttgaaacagtttgcaccttcaccaaattgtaacaagacggaaattattgctactctgaaaaacggagatcaaacttgcctggaccccgactctgcaaacgtgaagaagctgatgaaggaatgggaaaaaaaaatctctcaaaagaaaaagcaaaagcgcggtaagaaacatcagaagaacatgaagaatcgtaagccaaagacccctcagtcgcgccgtcgttctcgtaagacgacgtaa

SEQ ID NO: 1085 - DNA, 284 bp, Artificial Sequence
  Description of Artificial Sequence: Synthetic polynucleotide
atgaagcagagcaccatcgcgcttgccctgctgccgttgcttttcacgcctgtcaccaaggctgtgcccctgagccgcaccgtgcgttgtacgtgtatctccatctcaaaccagccggtaaacccgcgtagtttagaaaaactggagattatcccagccagccagttttgcccgcgcgttgagattattgcgaccatgaagaaaaaaggggaaaaacgttgccttaatccagaaagtaaggctatcaaaaacctgttgaaagctgtctcgaaagagcgttccta

SEQ ID NO: 1086 - DNA, 1204 bp, Artificial Sequence
  Description of Artificial Sequence: Synthetic polynucleotide
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaataagtttatcaaaataaaaggaggtaatatatgaagcagagcaccatcgcgcttgccctgctgccgttgcttttcacgcctgtcaccaaggctatcccactggctcgcacagtccgctgtaattgcatccacatcgatgacggtcctgtgcgtatgcgtgcaatcggtaaacttgaaattatccctgcctccttatcgtgtccccgcgtagagattatcgccacgatgaagaaaaacgatgaacagcgttgtcttaacccagagagcaaaactatcaaaaacctgatgaaggcttttagtcaaaagcgcagtaagcgcgcaccataaaacgattggtaaacccggtgaacgcatgagaaagcccccggaagatcaccttccgggggcttttttattgcgcggaccaaaacgaaaaaagacgctcgaaagcgtctcttttctggaatttggtaccgagg

SEQ ID NO: 1087 - DNA, 375 bp, Artificial Sequence; identical to SEQ ID NO: 1083
  Description of Artificial Sequence: Synthetic polynucleotide

SEQ ID NO: 1088 - DNA, 1288 bp, Artificial Sequence
  Description of Artificial Sequence: Synthetic polynucleotide
ccaggatacatagattaccacaactccgagcccttccaccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaataagtttatcaaaataaaaggaggtaatatatgaagcagagcaccatcgcgcttgccctgctgccgttgcttttcacgcctgtcaccaaggctacgctggtgatccgtaacgcccgctgttcatgcatcagcacttctcgtggaaccatccactataaatcattaaaggacttgaaacagtttgcaccttcaccaaattgtaacaagacggaaattattgctactctgaaaaacggagatcaaacttgcctggaccccgactctgcaaacgtgaagaagctgatgaaggaatgggaaaaaaaaatctctcaaaagaaaaagcaaaagcgcggtaagaaacatcagaagaacatgaagaatcgtaagccaaagacccctcagtcgcgccgtcgttctcgtaagacgacgtaaaacgattggtaaacccggtgaacgcatgagaaagcccccggaagatcaccttccgggggcttttttattgcgcggaccaaaacgaaaaaagacgctcgaaagcgtctcttttctggaatttggtaccgagg

SEQ ID NO: 1089 - DNA, 858 bp, Artificial Sequence
  Description of Artificial Sequence: Synthetic polynucleotide
aaacaatcgaccatcgcattggcgctgcttcctctattgttcacaccggtgacaaaggcagtcgactataaggatgacgacgacaagcaattgggcggtggccaccgtcgtttggacaaggtggaggaggaagtcaacttgcatgaagattttgtatttatcaagaaattaaagcgttgtaacaagggtgaagggagcttgagtttacttaactgtgaagaaatgcgccgccaattcgaggacttggttaaggacattacccttaacaaggaagaaaagaaagagaacagcttcgaaatgcagcgtggcgatgaagacccccagatcgcggcacatgtcgtttccgaggcaaattcgaatgctgcttcagtcttacaatgggcgaaaaagggctactacacgatgaagtcaaacttagtgatgcttgaaaatggcaagcaattaaccgtgaagcgcgaaggattgtattatgtctacacccaagtaacattttgctccaatcgcgaaccgtcgtcgcagcgccctttcatcgttggtttgtggttgaagccgagctccggttccgagcgtattcttttgaaagccgcaaacacccacagcagctcgcagctgtgtgaacagcagagcgtccacctgggcggcgtatttgaattgcaagcgggagcgtcagttttcgttaatgtgactgaggcttctcaagttatccatcgtgtcggtttctccagcttcggcttactgaagttaaagggcgagctcaattcgaagcttgaaggtaagcctatccctaaccctctcctcggcctcgattctacggatccgaattcgagctccgtcgaccatcaccatcaccaccactga

SEQ ID NO: 1090 - DNA, 791 bp, Artificial Sequence
  Description of Artificial Sequence: Synthetic polynucleotide
tgactagtaaacaatcgaccatcgcattggcgctgcttcctctattgttcacaccggtgacaaaggcagtcgactataaggatgacgacgacaagcaattgggcggtggcatgcaacgtggcgatgaggacccgcaaattgccgcgcatgttgtgtccgaagcgaactccaatgccgcatccgtcctgcaatgggctaagaaaggctattacacgatgaaatcaaacctggttatgcttgagaacggaaagcagcttacagtcaagcgtgagggcctgtattacgtctacacccaagttaccttttgctctaaccgtgagcccagcagccaacgcccttttattgtaggcctgtggttaaagccctcgtcgggttctgaacgcattcttctgaaagctgcgaatacgcactctagtagccagctgtgtgagcaacaatctgtccatcttggtggagtttttgagttacaagctggagcatctgtgttcgtgaatgtaacggaagcatctcaagttatccaccgtgtaggcttctcatcttttggtttattaaaattaaagggcgagctcaattcgaagcttgaaggtaagcctatccctaaccctctcctcggcctcgattctacggatccgaattcgagctccgtcgaccatcaccatcaccaccactgagcatgctaatcagccgtggaattcggtctcaggaggatcagttctggaccagcgagctgtgctgcgactcgtggcgtaatcatggtcatagctgtttcctgtgtgaaattgttatccgct

SEQ ID NO: 1091 - protein, 288 aa, Artificial Sequence
  Description of Artificial Sequence: Synthetic polypeptide
MTSKQSTIALALLPLLFTPVTKAVDYKDDDDKQLGGGHRRLDKVEEEVNLHEDFVFIKKLKRCNKGEGSLSLLNCEEMRRQFEDLVKDITLNKEEKKENSFEMQRGDEDPQIAAHVVSEANSNAASVLQWAKKGYYTMKSNLVMLENGKQLTVKREGLYYVYTQVTFCSNREPSSQRPFIVGLWLKPSSGSERILLKAANTHSSSQLCEQQSVHLGGVFELQAGASVFVNVTEASQVIHRVGFSSFGLLKLKGELNSKLEGKPIPNPLLGLDSTDPNSSSVDHHHHHH

SEQ ID NO: 1092 - protein, 223 aa, Artificial Sequence
  Description of Artificial Sequence: Synthetic polypeptide
MTSKQSTIALALLPLLFTPVTKAVDYKDDDDKQLGGGMQRGDEDPQIAAHVVSEANSNAASVLQWAKKGYYTMKSNLVMLENGKQLTVKREGLYYVYTQVTFCSNREPSSQRPFIVGLWLKPSSGSERILLKAANTHSSSQLCEQQSVHLGGVFELQAGASVFVNVTEASQVIHRVGFSSFGLLKLKGELNSKLEGKPIPNPLLGLDSTDPNSSSVDHHHHHH

SEQ ID NO: 1093 - protein, 215 aa, Artificial Sequence
  Description of Artificial Sequence: Synthetic polypeptide
HRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 1094 - DNA, 1251 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggcggtggcaaggaactgaaagtcacccagcctgagaagtctgtctcagtagcggcaggtgacagcacggtgcttaactgcacgcttacttcactgctgccggtaggtcccattaaatggtatcgtggcgtgggccaaagtcgtttgttaatctactcctttacgggtgagcactttccgcgcgtaactaatgtaagcgacgcaacaaaacgtaacaacatggatttcagcattcgcatctcaaacgtcactcccgaggatgctgggacttactactgcgtaaaatttcagaaaggcccctcagagcccgatacagaaatccaatcaggaggcggcacagaagtctacgttctggcaaaaccctctccccctgaagtctccggtccagcagatcgtggcattcctgaccaaaaagtaaatttcacgtgcaaatcgcacgggtttagcccacgcaacatcacactgaagtggtttaaagatggtcaggaacttcatcaccttgagactaccgtgaacccgtccggtaaaaacgtttcctacaatatctcgtccactgtgcgtgttgtattgaatagcatggacgttcacagcaaggtgatctgtgaagtcgctcacattacccttgaccgttcaccattgcgtggtatcgcgaacctgagcaatttcatccgtgtcagcccgacggttaaggttactcagcagtccccaacatcgatgaaccaggtaaatctgacgtgtcgtgcagaacgtttttaccctgaagacctgcagttgatttggctggagaacgggaacgtctcgcgcaatgacacacccaaaaatctgacaaagaatactgacggtacgtacaattatacatcactgtttcttgtgaactcctccgcccatcgcgaggacgtagtctttacatgtcaagtcaagcacgatcagcagcccgcgatcacccgtaatcacacagttctgggcctggctcactcatccgatcagggatcaatgcaaacatttccgggaaacaatgcaacccacaactggaataagggcgagctcaattcgaagcttgaaggtaagcctatccctaaccctctcctcggcctcgattctacggatccgaattcgagctccgtcgaccatcaccatcaccaccactga

SEQ ID NO: 1095 - DNA, 564 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggtggtagcgaagaagaactgcagattatccaaccggacaaatctgttctggtggctgcgggtgaaacggctactttgcgctgcacaatcacctcgctgtttccagtcggaccaatccaatggttccgtggtgcgggaccgggtcgcgtgttgatctacaatcagcgtcaaggccctttcccccgtgttactactgtctccgatacaacaaagcgcaacaacatggacttttccatccgtatcgggaatatcacaccggccgacgcgggaacctattattgcatcaagtttcgcaagggatctccagacgatgttgaatttaagagcggggctggaactgagctgtccgtgcgtgcaaaaccttcgggcagcggcgagctcggtggcagtggtaagcctatccctaaccctctcctcggcctcgattctacgggatccggtcatcatcaccatcaccattga

SEQ ID NO: 1096 - DNA, 357 bp, Artificial Sequence
  Description of Artificial Sequence: Synthetic polynucleotide
gaagaagaactgcagattatccaaccggacaaatctgttctggtggctgcgggtgaaacggctactttgcgctgcacaatcacctcgctgtttccagtcggaccaatccaatggttccgtggtgcgggaccgggtcgcgtgttgatctacaatcagcgtcaaggccctttcccccgtgttactactgtctccgatacaacaaagcgcaacaacatggacttttccatccgtatcgggaatatcacaccggccgacgcgggaacctattattgcatcaagtttcgcaagggatctccagacgatgttgaatttaagagcggggctggaactgagctgtccgtgcgtgcaaaaccttcg

SEQ ID NO: 1097 - DNA, 945 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggtggtagcgaggaggaagtgcaaatcattcaacccgacaaaagcgttagtgtcgcggcgggtgagtccgccatcctgcattgcactatcacatccctgtttcccgtaggtcccattcaatggtttcgtggagccggtccggcgcgtgttcttatctacaatcaacgccagggacccttcccgcgtgttacaacgatcagtgaaactacccgtcgtgaaaacatggactttagcatttcgatctccaacattacacccgctgacgcagggacgtactactgcatcaagtttcgtaaaggatctccagacactgagtttaagtctggcgcagggacggagttgtccgtgcgtgcgaaaccttctggcggaggagggtcggggggcggtggttctgaagaggaagttcagattatccaaccagataaatcagtgtccgtggcggcgggagagtcagctatccttcactgtacaatcacatcgttattccctgtagggccaattcagtggttccgtggggcaggacccgcacgtgtccttatctataatcagcgtcaggggcccttcccacgtgttacgacaatttcagagactactcgccgcgagaacatggacttcagtattagcatctcgaacattaccccggcggacgcgggaacttattactgtatcaagtttcgtaaaggctcgccggacaccgagttcaaatccggggcaggcactgagttgagcgtgcgtgcgaaaccatcgggcagcggcgagctcggtggcagtggtaagcctatccctaaccctctcctcggcctcgattctacgggatccggtcatcatcaccatcaccattga

SEQ ID NO: 1098 - DNA, 1224 bp, Artificial Sequence
  Description of Artificial Sequence: Synthetic polynucleotide
atgactagtaaacaatcgaccatcgcattggcgctgcttcctctattgttcacaccggtgacaaaggcacaattgggtggtagcgaggaggagttacaaattatccaaccagataagtctgtcttggtcgcagccggagaaacggcgacgttacgctgcacaatcacctcactgttcccggtcggtccgattcagtggttccgtggagctggtccgggccgtgtcttaatttacaatcaacgtcaaggaccttttccacgcgtaacaactgtttctgacacaaccaaacgtaacaatatggacttttctattcgtattggcaacattacgccagccgatgcaggtacatactactgtatcaaattccgtaaaggtagtcctgatgacgttgagtttaaaagcggcgcagggacggagctttcagtgcgtgcaaagcccagtgctagcgcggcggcgccgccatgcccgccatgccctgcgcccgagttcttgggtgggccttcagtgttcctttttcccccgaaaccaaaagataccctgatgatttcgcgcacccctgaagttacttgtgtggttgttgacgtctcacaagaggacccagaggtacaattcaactggtatgtggacggagtagaggtgcataacgccaagactaagccccgtgaagagcagttcaattctacataccgtgtagtttcggttttaacggtcttacaccaagattggttgaacggaaaggaatataagtgcaaggtgtccaataagggactgccaagcagtatcgaaaaaacaatctcaaaagcaaagggacaaccgcgtgagccccaggtttacactctgccaccgtcgcaagaggagatgacgaagaatcaggtgtcgttaacctgtttggtcaaaggcttttatccaagcgatatcgcagtggaatgggaatcaaatgggcagcctgaaaataactataagacaaccccgcctgtacttgattctgatggatctttttttctttatagtcgcttaaccgtggataaatcccgttggcaggaaggtaatgtcttctcatgctcggttatgcacgaggcccttcataaccattacactcagaagagcctttctctgagtccggggaaaggcagcggcgagctcggtggcagtggtaagcctatccctaaccctctcctcggcctcgattctacgggatccggtcatcatcaccatcaccattga

SEQ ID NO: 1099 - DNA, 1128 bp, Artificial Sequence
  Description of Artificial Sequence: Synthetic polynucleotide
atgactagtaaacaatcgaccatcgcattggcgctgcttcctctattgttcacaccggtgacaaaggcacaattgggtggtagcgaggaggagttacaaattatccaaccagataagtctgtcttggtcgcagccggagaaacggcgacgttacgctgcacaatcacctcactgttcccggtcggtccgattcagtggttccgtggagctggtccgggccgtgtcttaatttacaatcaacgtcaaggaccttttccacgcgtaacaactgtttctgacacaaccaaacgtaacaatatggacttttctattcgtattggcaacattacgccagccgatgcaggtacatactactgtatcaaattccgtaaaggtagtcctgatgacgttgagtttaaaagcggcgcagggacggagctttcagtgcgtgcaaagcccagtgctagcgcggcggcgccgccatgcccgccatgccctgcgcccgagttcttgggtgggccttcagtgttcctttttcccccgaaaccaaaagataccctgatgatttcgcgcacccctgaagttacttgtgtggttgttgacgtctcacaagaggacccagaggtacaattcaactggtatgtggacggagtagaggtgcataacgccaagactaagccccgtgaagagcagttcaattctacataccgtgtagtttcggttttaacggtcttacaccaagattggttgaacggaaaggaatataagtgcaaggtgtccaataagggactgccaagcagtatcgaaaaaacaatctcaaaagcaaagggacaaccgcgtgagccccaggtttacactctgccaccgtcgcaagaggagatgacgaagaatcaggtgtcgttaacctgtttggtcaaaggcttttatccaagcgatatcgcagtggaatgggaatcaaatgggcagcctgaaaataactataagacaaccccgcctgtacttgattctgatggatctttttttctttatagtcgcttaaccgtggataaatcccgttggcaggaaggtaatgtcttctcatgctcggttatgcacgaggcccttcataaccattacactcagaagagcctttctctgagtccggggaaa

SEQ ID NO: 1100 - DNA, 1128 bp, Artificial Sequence; identical to SEQ ID NO: 1099
  Description of Artificial Sequence: Synthetic polynucleotide

SEQ ID NO: 1101 - DNA, 1191 bp, Artificial Sequence
  Description of Artificial Sequence: Synthetic polynucleotide
atgactagtaaacaatcgaccatcgcattggcgctgcttcctctattgttcacaccggtgacaaaggcacaattgggtggtagcgaagaagaggtgcagatcatccaacccgataaatcggtatctgtcgcagctggggagtcggcgattttgcattgcaccattacatctttgttccctgttgggcctattcaatggtttcgcggggcaggtccggcccgcgtattgatttataaccagcgtcaaggaccgttcccccgtgttacaactatttcggaaacaacacgtcgtgaaaatatggatttctcgatctctatctctaacattactcccgccgatgcagggacttattattgcattaaatttcgcaaaggaagccccgacacggagtttaagagtggagcgggcacggaattatcggtgcgcgcgaaacccagtgctagcgcggcggcgccgccatgcccgccatgccctgcgcccgagttcttgggtgggccttcagtgttcctttttcccccgaaaccaaaagataccctgatgatttcgcgcacccctgaagttacttgtgtggttgttgacgtctcacaagaggacccagaggtacaattcaactggtatgtggacggagtagaggtgcataacgccaagactaagccccgtgaagagcagttcaattctacataccgtgtagtttcggttttaacggtcttacaccaagattggttgaacggaaaggaatataagtgcaaggtgtccaataagggactgccaagcagtatcgaaaaaacaatctcaaaagcaaagggacaaccgcgtgagccccaggtttacactctgccaccgtcgcaagaggagatgacgaagaatcaggtgtcgttaacctgtttggtcaaaggcttttatccaagcgatatcgcagtggaatgggaatcaaatgggcagcctgaaaataactataagacaaccccgcctgtacttgattctgatggatctttttttctttatagtcgcttaaccgtggataaatcccgttggcaggaaggtaatgtcttctcatgctcggttatgcacgaggcccttcataaccattacactcagaagagcctttctctgagtccggggaaaggcagcggcgagctcggtggcagtggtaagcctatccctaaccctctcctcggcctcgattctacg

SEQ ID NO: 1102 - DNA, 1041 bp, Artificial Sequence
  Description of Artificial Sequence: Synthetic polynucleotide
gaagaagaggtgcagatcatccaacccgataaatcggtatctgtcgcagctggggagtcggcgattttgcattgcaccattacatctttgttccctgttgggcctattcaatggtttcgcggggcaggtccggcccgcgtattgatttataaccagcgtcaaggaccgttcccccgtgttacaactatttcggaaacaacacgtcgtgaaaatatggatttctcgatctctatctctaacattactcccgccgatgcagggacttattattgcattaaatttcgcaaaggaagccccgacacggagtttaagagtggagcgggcacggaattatcggtgcgcgcgaaacccagtgctagcgcggcggcgccgccatgcccgccatgccctgcgcccgagttcttgggtgggccttcagtgttcctttttcccccgaaaccaaaagataccctgatgatttcgcgcacccctgaagttacttgtgtggttgttgacgtctcacaagaggacccagaggtacaattcaactggtatgtggacggagtagaggtgcataacgccaagactaagccccgtgaagagcagttcaattctacataccgtgtagtttcggttttaacggtcttacaccaagattggttgaacggaaaggaatataagtgcaaggtgtccaataagggactgccaagcagtatcgaaaaaacaatctcaaaagcaaagggacaaccgcgtgagccccaggtttacactctgccaccgtcgcaagaggagatgacgaagaatcaggtgtcgttaacctgtttggtcaaaggcttttatccaagcgatatcgcagtggaatgggaatcaaatgggcagcctgaaaataactataagacaaccccgcctgtacttgattctgatggatctttttttctttatagtcgcttaaccgtggataaatcccgttggcaggaaggtaatgtcttctcatgctcggttatgcacgaggcccttcataaccattacactcagaagagcctttctctgagtccggggaaa

SEQ ID NO: 1103 - DNA, 681 bp, Homo sapiens
gcggcggcgccgccatgcccgccatgccctgcgcccgagttcttgggtgggccttcagtgttcctttttcccccgaaaccaaaagataccctgatgatttcgcgcacccctgaagttacttgtgtggttgttgacgtctcacaagaggacccagaggtacaattcaactggtatgtggacggagtagaggtgcataacgccaagactaagccccgtgaagagcagttcaattctacataccgtgtagtttcggttttaacggtcttacaccaagattggttgaacggaaaggaatataagtgcaaggtgtccaataagggactgccaagcagtatcgaaaaaacaatctcaaaagcaaagggacaaccgcgtgagccccaggtttacactctgccaccgtcgcaagaggagatgacgaagaatcaggtgtcgttaacctgtttggtcaaaggcttttatccaagcgatatcgcagtggaatgggaatcaaatgggcagcctgaaaataactataagacaaccccgcctgtacttgattctgatggatctttttttctttatagtcgcttaaccgtggataaatcccgttggcaggaaggtaatgtcttctcatgctcggttatgcacgaggcccttcataaccattacactcagaagagcctttctctgagtccggggaaa

SEQ ID NO: 1104 - DNA, 929 bp, Artificial Sequence
  Description of Artificial Sequence: Synthetic polynucleotide
atgactagtaaacaatcgaccatcgcattggcgctgcttcctctattgttcacaccggtgacaaaggcacaattgggtggtagccaggttaagttgcttcagtccggtgccgcattagtgaagcctggagcaagtgtcaagatgtcgtgtcaggcaagcgggtacagcttcaccgattattgggtgacgtgggttaaacaatcccacggacaatcattggaatggatcggggaaatctaccccagtaacactgtgacaaattttaacgacaattttaaagggaaggcaacccttacggtggataagtctacttccacagcgtatatggagctgagtcgcctgacttctgaggactctgccatctattactgtacacgtatcgggaacagtgggtatcgtgtagggtggttcatctactgggggcaaggtacccttgtgacagttttatccgggggtggcgggtcgggaggggggggatcaggcggtggagggtcggatacagttctgacccagtctccggcattggcggtgtcaccgggggagcgtgtcacgatcagttgtaaggcatcggaatccgtgtcgagccacatgcactggtaccagcagaaaccggggcagcagcctaaactgttgatttacaaggcatcaaatttagcctctggtgtacccgctcgttttagtggcagtggctcgggaacggacttcactttaacgattgaccctgttgaggcagacgataccgccacttacttctgccagcagggttggaacggcccattcacttttggggccgggacccgtctggaactgaagcgcgcggacgccgctggcagcggcgagctcggtggcagtggtaagcctatccctaaccctctcctcggcctcgattctacgggatccggtcatcaccaccatcaccatcaccattg

SEQ ID NO: 1105 - protein, 415 aa, Artificial Sequence
  Description of Artificial Sequence: Synthetic polypeptide
MTSKQSTIALALLPLLFTPVTKAVDYKDDDDKQLGGGKELKVTQPEKSVSVAAGDSTVLNCTLTSLLPVGPIKWYRGVGQSRLLIYSFTGEHFPRVTNVSDATKRNNMDFSIRISNVTPEDAGTYYCVKFQKGPSEPDTEIQSGGGTEVYVLAKPSPPEVSGPADRGIPDQKVNFTCKSHGFSPRNITLKWFKDGQELHHLETTVNPSGKNVSYNISSTVRVVLNSMDVHSKVICEVAHITLDRSPLRGIANLSNFIRVSPTVKVTQQSPTSMNQVNLTCRAERFYPEDLQLIWLENGNVSRNDTPKNLTKNTDGTYNYTSLFLVNSSAHREDVVFTCQVKHDQQPAITRNHTVLGLAHSSDQGSMQTFPGNNATHNWNKGELNSKEGKPIPNPLLGLDSTDPNSSSVDHHHHHH

SEQ ID NO: 1106 - protein, 187 aa, Artificial Sequence
  Description of Artificial Sequence: Synthetic polypeptide
MTSKQSTIALALLPLLFTPVTKAVDYKDDDDKQLGGSEEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKPSGSGELGGSGKPIPNPLLGLDSTGSGHHHHHH

SEQ ID NO: 1107 - protein, 119 aa, Artificial Sequence
  Description of Artificial Sequence: Synthetic polypeptide
EEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKPS

SEQ ID NO: 1108 - protein, 314 aa, Artificial Sequence
  Description of Artificial Sequence: Synthetic polypeptide
MTSKQSTIALALLPLLFTPVTKAVDYKDDDDKQLGGSEEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSGGGGSGGGGSEEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSGSGELGGSGKPIPNPLLGLDSTGSGHHHHHH

SEQ ID NO: 1109 - protein, 246 aa, Artificial Sequence
  Description of Artificial Sequence: Synthetic polypeptide
EEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSGGGGSGGGGSEEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPS

SEQ ID NO: 1110 - protein, 416 aa, Artificial Sequence
  Description of Artificial Sequence: Synthetic polypeptide
MTSKQSTIALALLPLLFTPVTKAVDYKDDDDKQLGGSEEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSGELGGSGKPIPNPLLGLDSTGSGHHHHHH

SEQ ID NO: 1111 - protein, 385 aa, Artificial Sequence
  Description of Artificial Sequence: Synthetic polypeptide
MTSKQSTIALALLPLLFTPVTKAVDYKDDDDKQLGGSEEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1112 - protein, 348 aa, Artificial Sequence
  Description of Artificial Sequence: Synthetic polypeptide
EEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1113 - protein, 407 aa, Artificial Sequence
  Description of Artificial Sequence: Synthetic polypeptide
MTSKQSTIALALLPLLFTPVTKAQLGGSEEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSGELGGSGGKPIPNPLLGLDSTGSGHHHHHH

SEQ ID NO: 1114 - protein, 375 aa, Artificial Sequence
  Description of Artificial Sequence: Synthetic polypeptide
MTSKQSTIALALLPLLFTPVTKAQLGGSEEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1115 - protein, 347 aa, Artificial Sequence
  Description of Artificial Sequence: Synthetic polypeptide
EEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPSASAAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1116 - protein, 118 aa, Artificial Sequence
  Description of Artificial Sequence: Synthetic polypeptide
EEEVQIIQPDKSVSVAAGESAILHCTITSLFPVGPIQWFRGAGPARVLIYNQRQGPFPRVTTISETTRRENMDFSISISNITPADAGTYYCIKFRKGSPDTEFKSGAGTELSVRAKPS

SEQ ID NO: 1117 - protein, 227 aa, Artificial Sequence
  Description of Artificial Sequence: Synthetic polypeptide
AAAPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1118 - protein, 307 aa, Artificial Sequence
  Description of Artificial Sequence: Synthetic polypeptide
MTSKQSTIALALLPLLFTPVTKAQLGGSQVKLLQSGAALVKPGASVKMSCQASGYSFTDYWVTWVKQSHGQSLEWIGEIYPSNTVTNFNDNFKGKATLTVDKSTSTAYMELSRLTSEDSAIYYCTRIGNSGYRVGWFIYWGQGTLVTVLSGGGGSGGGGSGGGGSDTVLTQSPALAVSPGERVTISCKASESVSSHMHWYQQKPGQQPKLLIYKASNLASGVPARFSGSGSGTDFTLTIDPVEADDTATYFCQQGWNGPFTFGAGTRLELKRADAAGSGELGGSGKPIPNPLLGLDSTGSGHHHHHH

SEQ ID NO: 1119 - protein, 21 aa, Homo sapiens
IVVGVVCTLLVALLMAALYLV

SEQ ID NO: 1120 - protein, 110 aa, Homo sapiens
RIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 1121 - protein, 16 aa, Artificial Sequence
  Description of Artificial Sequence: Synthetic peptide
SGGGGSGGGGSGGGGS

SEQ ID NO: 1122 - DNA, 1452 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggcggtggctttcgtgggccattgttacccaaccgtccattcaccactgtctggaacgccaatacacaatggtgtttggagcgtcatggagtcgatgtagatgtatccgtgtttgatgtcgtggcgaacccgggacagacatttcgtggaccggacatgaccatcttttattcgtcacaacttggcacctacccttattacactcccacgggtgagcctgtctttggtggacttcctcaaaatgcttctttgattgcgcacttggcgcgtactttccaagatatcctggctgccatccctgccccggatttttcgggactggctgtaattgattgggaggcatggcgccctcgttgggccttcaactgggatacaaaggacatttaccgccaacgcagccgcgccttggttcaggcccaacaccccgactggccggcgccccaggtggaagcagttgcacaggaccagttccaaggagccgctcgcgcttggatggcgggtactttacagttggggcgcgctttgcgtcctcgcggcttgtggggattctatggttttccagactgctataactacgacttcttgtctcccaactacaccggacagtgtccctctgggattcgtgctcagaatgaccaacttggatggctgtggggccaaagtcgtgcgctgtatccgagcatttatatgccagccgttctggaaggaacaggcaagtctcagatgtacgttcaacatcgtgtagcggaagcctttcgtgtagccgtggcggcaggtgacccaaatttgccggtcttaccttacgtacagattttttatgacactacaaatcacttccttccactggatgagttagaacattcattgggggagtcagcagctcagggcgcggctggggtggtgttgtgggtgagctgggaaaacacgcgtacgaaagagtcatgccaggctatcaaggaatacatggatacaactcttggtccgtttattttgaatgtgacttctggggcgcttttgtgttcccaggctctttgctcaggtcatgggcgttgcgttcgccgtacctcgcatccgaaagcgcttctgcttctgaacccagcgtcattcagcattcaactgacacctggagggggtcctttatcactgcgcggggctttatctttggaagaccaagctcagatggcggtcgagttcaagtgtcgctgctacccaggttggcaggccccgtggtgcgagcgtaaaagtatgtggaagggcgagctcaattcgaagcttgaaggtaagcctatccctaaccctctcctcggcctcgattctacgcgtaccggtcatcatcaccatcaccattga

SEQ ID NO: 1123 - DNA, 1353 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggcggtggctttcgtgggccattgttacccaaccgtccattcaccactgtctggaacgccaatacacaatggtgtttggagcgtcatggagtcgatgtagatgtatccgtgtttgatgtcgtggcgaacccgggacagacatttcgtggaccggacatgaccatcttttattcgtcacaacttggcacctacccttattacactcccacgggtgagcctgtctttggtggacttcctcaaaatgcttctttgattgcgcacttggcgcgtactttccaagatatcctggctgccatccctgccccggatttttcgggactggctgtaattgattgggaggcatggcgccctcgttgggccttcaactgggatacaaaggacatttaccgccaacgcagccgcgccttggttcaggcccaacaccccgactggccggcgccccaggtggaagcagttgcacaggaccagttccaaggagccgctcgcgcttggatggcgggtactttacagttggggcgcgctttgcgtcctcgcggcttgtggggattctatggttttccagactgctataactacgacttcttgtctcccaactacaccggacagtgtccctctgggattcgtgctcagaatgaccaacttggatggctgtggggccaaagtcgtgcgctgtatccgagcatttatatgccagccgttctggaaggaacaggcaagtctcagatgtacgttcaacatcgtgtagcggaagcctttcgtgtagccgtggcggcaggtgacccaaatttgccggtcttaccttacgtacagattttttatgacactacaaatcacttccttccactggatgagttagaacattcattgggggagtcagcagctcagggcgcggctggggtggtgttgtgggtgagctgggaaaacacgcgtacgaaagagtcatgccaggctatcaaggaatacatggatacaactcttggtccgtttattttgaatgtgacttctggggcgcttttgtgttcccaggctctttgctcaggtcatgggcgttgcgttcgccgtacctcgcatccgaaagcgcttctgcttctgaacccagcgtcattcagcattcaactgacacctggagggggtcctttatcactgcgcggggctttatctttggaagaccaagctcagatggcggtcgagttcaagtgtcgctgctacccaggttggcaggccccgtggtgcgagcgtaaaagtatgtgg

SEQ ID NO: 1124 - DNA, 1440 bp, Artificial Sequence
  Description of Artificial Sequence: Synthetic polynucleotide
atgactagtaaacaatcgaccatcgcattggcgctgcttcctctattgttcacaccggtgacaaaggcagtcgactataaggatgacgacgacaagcaattgggcggtggctctgttgttagcaaccgtccctttatcactgtgtggaacggtgacacacattggtgtttaaccgagtacggggtcgatgtggacgtttcggtctttgacgtcgtggctaataaagagcaatctttccaaggctctaatatgaccatcttctatcgtgaagagcttggcacatacccatactacaccccaactggcgagccagtctttggggggcttccgcaaaatgcctctttggtgactcatctggcgcataccttccaagatatcaaagcggcgatgcccgaaccagatttttccgggttagcggtaatcgactgggaggcatggcgtcctcgctgggcttttaactgggatagtaaagatatttatcgccaacgttctatggaacttgtgcaagcagaacatcctgattggcctgagaccctggtggaggcagctgctaaaaatcagttccaggaggcagcagaagcgtggatggccggaacgctgcagttggggcaagtgttgcgcccgcgcggactttggggctattatggattccccgactgttataacaatgacttcctttcgttaaattacaccggccaatgtcccgtgttcgttcgtgatcagaatgatcagttgggatggttgtggaaccagtcatacgccctttatccatccatctatttacccgccgctttaatgggcacggagaaatctcagatgtatgttcgccaccgtgttcaggaagcattgcgtgttgctattgtttcccgtgacccccacgttccggtcatgccatacgtccaaatcttttacgaaatgaccgactatttgttaccgttagaagagcttgaacacagtttgggggagtcagctgcacaaggtgtagcgggagcagtgctttggttgagttcagacaaaacgtctactaaagaatcatgtcaagcaattaaagcatacatggattccaccttgggtccgtttatcgtgaacgtcacatcggcggcattgttatgctcagaagccctttgctcggggcatggccgctgtgttcgtcatccaagctaccccgaggctctgttgacattgaatcctgcaagtttttcgatcgaactgacacatgacgggcgcccacccagtcttaaaggcaccctttcattgaaagatcgtgctcagatggcgatgaaattccgctgtcgttgctatcgtggttggcgcggcaagtggtgcgataaacgtggtatgaagggcgagctcaattcgaagcttgaaggtaagcctatccctaaccctctcctcggcctcgattctacgcgtaccggtcatcatcaccatcaccattga

SEQ ID NO: 1125 - DNA, 1580 bp, Artificial Sequence
  Description of Artificial Sequence: Synthetic polynucleotide
atgaaacaatcgaccatcgcattggcgctgcttcctctattgttcacaccggtgacaaaggcacaattgggcggtggcatgaaagagattgctgttaccatcgacgataaaaacgtgattgcttcagtcagtgaaagctttcacggcgtcgctttcgacgcttccctgttttctccgaaaggcctgtggagttttgttgacattacgtcacccaagctgtttaaactgcttgagggcctgtctccaggttactttcgcgttggcgggacattcgcgaactggttattcttcgacttagacgagaacaacaagtggaaggattactgggcttttaaagacaaaactcctgagacagccacaattacgcgccgttggttgtttcgcaagcaaaacaatttaaagaaggagacgttcgatgatcttgtcaagctgactaaaggatcaaagatgcgtcttttgtttgacctgaatgcagaagttcgcacagggtacgaaattggcaaaaagatgaccagcacttgggattcatctgaagctgaaaagctgttcaagtactgtgttagcaagggttacggagacaatattgactgggagcttggtaacgaacccgaccacacaagcgcacataacttaactgagaagcaggtgggtgaagatttcaaggcgctgcataaagttttggagaagtatccaaccttaaataaaggatcgttggtagggcctgacgtagggtggatgggggtatcatacgttaaaggtctggccgatggtgcaggtgaccatgtgacagcttttacgttacatcaatactacttcgatggtaacacgtcggatgtgtcaacttacttggacgctacctactttaaaaagttacaacagctgttcgataaggtaaaagacgtcttgaaaaattccccacataaagacaaacccctttggcttggcgaaactagctcgggttacaacagcggaacgaaagatgtgtctgaccgttatgtgtcagggttcttgacacttgataaattgggccttagcgccgctaacaacgtgaaggtcgtcattcgccagactatctataatggttactatggcttgttagacaaaaacacccttgagcctaacccggactattggttgatgcatgtacataactcgctggtagggaacactgtgttcaaggttgacgtgtctgatcctactaacaaggcccgtgtttacgcgcagtgtaccaaaactaatagcaaacatacacaatctcgctactacaaaggttcccttaccatttttgctttgaatgtcggcgacgaggatgtgaccttaaagattgaccaatattctgggaagaaaatttattcatatattctgactccagaggggggtcaactgaccagccaaaaagtacttttgaatggcaaggagttgaaactggtgagcgatcagcttccagagctgaacgcggatgagtccaaaacatcatttacattatctcctaagacgttcgggtttttcgtcgtgagtgacgctaatgtagaagcatgtaagaaaggatccggtcatcaccaccatcaccatcaccatta

SEQ ID NO: 1126 - DNA, 1545 bp, Artificial Sequence
  Description of Artificial Sequence: Synthetic polynucleotide
atgaaacaatcgaccatcgcattggcgctgcttcctctattgttcacaccggtgacaaaggcacaattgggcggtggcatgaaagagattgctgttaccatcgacgataaaaacgtgattgcttcagtcagtgaaagctttcacggcgtcgctttcgacgcttccctgttttctccgaaaggcctgtggagttttgttgacattacgtcacccaagctgtttaaactgcttgagggcctgtctccaggttactttcgcgttggcgggacattcgcgaactggttattcttcgacttagacgagaacaacaagtggaaggattactgggcttttaaagacaaaactcctgagacagccacaattacgcgccgttggttgtttcgcaagcaaaacaatttaaagaaggagacgttcgatgatcttgtcaagctgactaaaggatcaaagatgcgtcttttgtttgacctgaatgcagaagttcgcacagggtacgaaattggcaaaaagatgaccagcacttgggattcatctgaagctgaaaagctgttcaagtactgtgttagcaagggttacggagacaatattgactgggagcttggtaacgaacccgaccacacaagcgcacataacttaactgagaagcaggtgggtgaagatttcaaggcgctgcataaagttttggagaagtatccaaccttaaataaaggatcgttggtagggcctgacgtagggtggatgggggtatcatacgttaaaggtctggccgatggtgcaggtgaccatgtgacagcttttacgttacatcaatactacttcgatggtaacacgtcggatgtgtcaacttacttggacgctacctactttaaaaagttacaacagctgttcgataaggtaaaagacgtcttgaaaaattccccacataaagacaaacccctttggcttggcgaaactagctcgggttacaacagcggaacgaaagatgtgtctgaccgttatgtgtcagggttcttgacacttgataaattgggccttagcgccgctaacaacgtgaaggtcgtcattcgccagactatctataatggttactatggcttgttagacaaaaacacccttgagcctaacccggactattggttgatgcatgtacataactcgctggtagggaacactgtgttcaaggttgacgtgtctgatcctactaacaaggcccgtgtttacgcgcagtgtaccaaaactaatagcaaacatacacaatctcgctactacaaaggttcccttaccatttttgctttgaatgtcggcgacgaggatgtgaccttaaagattgaccaatattctgggaagaaaatttattcatatattctgactccagaggggggtcaactgaccagccaaaaagtacttttgaatggcaaggagttgaaactggtgagcgatcagcttccagagctgaacgcggatgagtccaaaacatcatttacattatctcctaagacgttcgggtttttcgtcgtgagtgacgctaatgtagaagcatgtaagaaa

SEQ ID NO: 1127 - protein, 483 aa, Artificial Sequence
  Description of Artificial Sequence: Synthetic polypeptide
MTSKQSTIALALLPLLFTPVTKAVDYKDDDDKQLGGGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMWKGELNSKLEGKPIPNPLLGLDSTRTGHHHHHH

SEQ ID NO: 1128 - protein, 414 aa, Artificial Sequence
  Description of Artificial Sequence: Synthetic polypeptide
FRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 1129 - protein, 451 aa, Artificial Sequence
  Description of Artificial Sequence: Synthetic polypeptide
MTSKQSTIALALLPLLFTPVTKAVDYKDDDDKQLGGGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 1130 - protein, 499 aa, Artificial Sequence
  Description of Artificial Sequence: Synthetic polypeptide
MTSKQSTIALALLPLLFTPVTKAKQSTIALALLPLLFTPVTKAVDYKDDDDKDLGGGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTEKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGMKGELNSKLEGKPIPNPLLGLDSTRTGHHHHHH

SEQ ID NO: 1131 - protein, 489 aa, Hirudo nipponia
MKEIAVTIDDKNVIASVSESFHGVAFDASLFSPKGLWSFVDITSPKLFKLLEGLSPGYFRVGGTFANWLFFDLDENNKWKDYWAFKDKTPETATITRRWLFRKQNNLKKETFDDLVKLTKGSKMRLLFDLNAEVRTGYEIGKKMTSTWDSSEAEKLFKYCVSKGYGDNIDWELGNEPDHTSAHNLTEKQVGEDFKALHKVLEKYPTLNKGSLVGPDVGWMGVSYVKGLADGAGDHVTAFTLHQYYFDGNTSDVSTYLDATYFKKLQQLFDKVKDVLKNSPHKDKPLWLGETSSGYNSGTKDVSDRYVSGFLTLDKLGLSAANNVKVVIRQTIYNGYYGLLDKNTLEPNPDYWLMHVHNSLVGNTVFKVDVSDPTNKARVYAQCTKTNSKHTQSRYYKGSLTIFALNVGDEDVTLKIDQYSGKKIYSYILTPEGGQLTSQKVLLNGKELKLVSDQLPELNADESKTSFTLSPKTFGFFVVSDANVEACKK

SEQ ID NO: 1132 - protein, 78 aa, Homo sapiens
ITCPPPMSVEHADIWVKSYSLYSRERYICNSGFKRKAGTSSLTECVLNKATNVAHWTTPSLKCIRDPALVHQRPAPPS

SEQ ID NO: 1133 - protein, 248 aa, Artificial Sequence
  Description of Artificial Sequence: Synthetic polypeptide
MFKSTLAAMAAVFALSALSPAAMADYKDDDDKIEGRITCPPPMSVEHADIWVKSYSLYSRERYICNSGFKRKAGTSSLTECVLNKATNVAHWTTPSLKCIRDPALVHQRPAPPSSGGSGGGGSGGGSGGGGSLQNWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1134 - protein, 212 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSSGGSGGGGSGGGSGGGGSLQNWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1135 - protein, 24 aa, Artificial Sequence
  Description of Artificial Sequence: Synthetic peptide
MFKSTLAAMAAVFALSALSPAAMA

SEQ ID NO: 1136 - protein, 114 aa, Homo sapiens
NWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1137 - protein, 20 aa, Artificial Sequence
  Description of Artificial Sequence: Synthetic peptide
SGGSGGGGSGGGSGGGGSLQ

SEQ ID NO: 1138 - DNA, 234 bp, Artificial Sequence
  Description of Artificial Sequence: Synthetic polynucleotide
atcacctgcccgcctccaatgtctgttgagcacgcagatatttgggtaaaatcttactctttatattcccgtgaacgctatatctgtaatagtggcttcaagcgcaaggcaggcacatcctcactgacggagtgtgttttaaacaaagcaacaaacgtcgctcactggacgacgcccagcctgaagtgcatccgcgacccggcattggtccatcaacgtccagcccctccctca

SEQ ID NO: 1139 - DNA, 747 bp, Artificial Sequence
  Description of Artificial Sequence: Synthetic polynucleotide
atgtttaagtctacacttgcagccatggccgcagtcttcgcactgtcagccttgagtcctgctgcaatggcagattataaagacgatgacgataagatcgaaggacgtatcacctgcccgcctccaatgtctgttgagcacgcagatatttgggtaaaatcttactctttatattcccgtgaacgctatatctgtaatagtggcttcaagcgcaaggcaggcacatcctcactgacggagtgtgttttaaacaaagcaacaaacgtcgctcactggacgacgcccagcctgaagtgcatccgcgacccggcattggtccatcaacgtccagcccctccctcatccggagggagcggcggcgggggtagtggaggcgggtcaggcggcgggggctcacttcagaactgggtgaatgtcatctcggacttaaagaagattgaagacttgattcagagcatgcatatcgacgcgactttatacaccgagtctgacgtacacccaagttgcaaggtcaccgccatgaagtgcttcttgcttgagttacaagtcatcagtttggaatctggagacgctagtattcacgatacggtggaaaacctgatcatccttgcaaatgactctctttcatccaatggtaatgttactgagtcggggtgcaaagaatgtgaagaacttgaggagaagaacattaaggaatttcttcagtcattcgtgcatatcgtacagatgttcatcaacacctcttaa

SEQ ID NO: 1140 - DNA, 639 bp, Artificial Sequence
  Description of Artificial Sequence: Synthetic polynucleotide
atcacctgcccgcctccaatgtctgttgagcacgcagatatttgggtaaaatcttactctttatattcccgtgaacgctatatctgtaatagtggcttcaagcgcaaggcaggcacatcctcactgacggagtgtgttttaaacaaagcaacaaacgtcgctcactggacgacgcccagcctgaagtgcatccgcgacccggcattggtccatcaacgtccagcccctccctcatccggagggagcggcggcgggggtagtggaggcgggtcaggcggcgggggctcacttcagaactgggtgaatgtcatctcggacttaaagaagattgaagacttgattcagagcatgcatatcgacgcgactttatacaccgagtctgacgtacacccaagttgcaaggtcaccgccatgaagtgcttcttgcttgagttacaagtcatcagtttggaatctggagacgctagtattcacgatacggtggaaaacctgatcatccttgcaaatgactctctttcatccaatggtaatgttactgagtcggggtgcaaagaatgtgaagaacttgaggagaagaacattaaggaatttcttcagtcattcgtgcatatcgtacagatgttcatcaacacctcttaa

SEQ ID NO: 1141 - DNA, 72 bp, Artificial Sequence
  Description of Artificial Sequence: Synthetic oligonucleotide
atgtttaagtctacacttgcagccatggccgcagtcttcgcactgtcagccttgagtcctgctgcaatggca

SEQ ID NO: 1142 - DNA, 63 bp, Artificial Sequence
  Description of Artificial Sequence: Synthetic oligonucleotide
atgaagcaggcgcttcgcgttgcgtttgggttccttatcctgtgggcatccgtacttcacgcc

SEQ ID NO: 1143 - DNA, 54 bp, Artificial Sequence
  Description of Artificial Sequence: Synthetic oligonucleotide
atgcgcgtactgttattccttctgttgtctctttttatgttgcccgctttcagt

SEQ ID NO: 1144 - DNA, 63 bp, Artificial Sequence
  Description of Artificial Sequence: Synthetic oligonucleotide
atgaagaagactgccatcgctattgccgtcgcccttgcgggtttcgcaaccgtggcgcaagca

SEQ ID NO: 1145 - DNA, 66 bp, Artificial Sequence
  Description of Artificial Sequence: Synthetic oligonucleotide
atgaaatatctgcttccaacggctgctgctggcctgttgcttcttgccgcccagcctgcgatggct

SEQ ID NO: 1146 - DNA, 1749 bp, Artificial Sequence
  Description of Artificial Sequence: Synthetic polynucleotide
atgaaaaagatttggctggctcttgccggtttagtcctggcattcagcgcaagcgcggtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1147 - DNA, 1755 bp, Artificial Sequence
  Description of Artificial Sequence: Synthetic polynucleotide
atgaaacagagcacaatcgctttagccttgctgcctcttcttttcacgcctgtcacgaaggcagtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1148 - DNA, 1755 bp, Artificial Sequence
  Description of Artificial Sequence: Synthetic polynucleotide
atgaagcaggctctgcgcgtggcatttgggttcctgatcttatgggcgtccgtcttacacgcagtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1149 - DNA, 1770 bp, Artificial Sequence
  Description of Artificial Sequence: Synthetic polynucleotide
atgaaaatcaagacgggggcacgcattcttgccttgagcgccttgacaacgatgatgttcagtgcaagtgcattagcggtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1150 - DNA, 1761 bp, Artificial Sequence
  Description of Artificial Sequence: Synthetic polynucleotide
atgaataagaaagtcttgacattgtcggcggtcatggcctcgatgttgttcggggcagcagcccacgcagtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1151 - DNA, 1758 bp, Artificial Sequence
  Description of Artificial Sequence: Synthetic polynucleotide
atgatgaagcgtaacatcttagccgttattgtccccgcattgcttgtggccgggacggctaacgcagtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1152 - DNA, 1755 bp, Artificial Sequence
  Description of Artificial Sequence: Synthetic polynucleotide
atgaagaagactgccatcgctattgccgtcgcccttgcgggtttcgcaaccgtggcgcaagcagtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1153 - DNA, 1746 bp, Artificial Sequence
  Description of Artificial Sequence: Synthetic polynucleotide
atgcgcgtgttattgttcttgctgctgagcttgtttatgttaccagctttcagtgtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1154 - DNA, 1767 bp, Artificial Sequence
  Description of Artificial Sequence: Synthetic polynucleotide
atgatgattaccttacgcaagttgccccttgcggtagccgttgctgctggtgtgatgtccgcgcaagcaatggctgtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1155 - skipped

SEQ ID NO: 1156 - DNA, 1758 bp, Artificial Sequence
  Description of Artificial Sequence: Synthetic polynucleotide
atgaaatatcttcttccaacggctgctgctggtttattgcttcttgccgcccagcctgcgatggctgtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1157 - DNA, 99 bp, Artificial Sequence
  Description of Artificial Sequence: Synthetic oligonucleotide
atggggtacaaaatgaacattagctcgcttcgcaaagcattcatttttatgggggctgttgcagctttaagccttgtcaatgcccagtcagcgcttgcc

SEQ ID NO: 1158 - DNA, 57 bp, Artificial Sequence
  Description of Artificial Sequence: Synthetic oligonucleotide
atgaaaaagatttggctggctcttgccggtttagtcctggcattcagcgcaagcgcg

SEQ ID NO: 1159 - DNA, 63 bp, Artificial Sequence
  Description of Artificial Sequence: Synthetic oligonucleotide
atgaaacagagcacaatcgctttagccttgctgcctcttcttttcacgcctgtcacgaaggca

SEQ ID NO: 1160 - DNA, 63 bp, Artificial Sequence
  Description of Artificial Sequence: Synthetic oligonucleotide
atgaagcaggctctgcgcgtggcatttgggttcctgatcttatgggcgtccgtcttacacgca

SEQ ID NO: 1161 - DNA, 78 bp, Artificial Sequence
  Description of Artificial Sequence: Synthetic oligonucleotide
atgaaaatcaagacgggggcacgcattcttgccttgagcgccttgacaacgatgatgttcagtgcaagtgcattagcg

SEQ ID NO: 1162 - DNA, 69 bp, Artificial Sequence
  Description of Artificial Sequence: Synthetic oligonucleotide
atgaataagaaagtcttgacattgtcggcggtcatggcctcgatgttgttcggggcagcagcccacgca

SEQ ID NO: 1163 - DNA, 66 bp, Artificial Sequence
  Description of Artificial Sequence: Synthetic oligonucleotide
atgatgaagcgtaacatcttagccgttattgtccccgcattgcttgtggccgggacggctaacgca

SEQ ID NO: 1164 - DNA, 63 bp, Artificial Sequence; identical to SEQ ID NO: 1144
  Description of Artificial Sequence: Synthetic oligonucleotide

SEQ ID NO: 1165 - DNA, 54 bp, Artificial Sequence
  Description of Artificial Sequence: Synthetic oligonucleotide
atgcgcgtgttattgttcttgctgctgagcttgtttatgttaccagctttcagt

SEQ ID NO: 1166 - DNA, 75 bp, Artificial Sequence
  Description of Artificial Sequence: Synthetic oligonucleotide
atgatgattaccttacgcaagttgccccttgcggtagccgttgctgctggtgtgatgtccgcgcaagcaatggct

SEQ ID NO: 1167 - DNA, 66 bp, Artificial Sequence
  Description of Artificial Sequence: Synthetic oligonucleotide
atgaaatatcttcttccaacggctgctgctggtttattgcttcttgccgcccagcctgcgatggct

SEQ ID NO: 1168 - DNA, 1554 bp, Artificial Sequence
  Description of Artificial Sequence: Synthetic polynucleotide
atctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcg

SEQ ID NO: 1169 - protein, 597 aa, Artificial Sequence
  Description of Artificial Sequence: Synthetic polypeptide
MGYKMNISSLRKAFIFMGAVAALSLVNAQSALAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1170 - protein, 583 aa, Artificial Sequence
  Description of Artificial Sequence: Synthetic polypeptide
MKKIWLALAGLVLAFSASAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1171 - protein, 585 aa, Artificial Sequence
  Description of Artificial Sequence: Synthetic polypeptide
MKQSTIALALLPLLFTPVTKAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1172 - protein, 585 aa, Artificial Sequence
  Description of Artificial Sequence: Synthetic polypeptide
MKQALRVAFGFLILWASVLHAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1173 - protein, 590 aa, Artificial Sequence
  Description of Artificial Sequence: Synthetic polypeptide
MKIKTGARILALSALTTMMFSASALAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1174 - protein, 587 aa, Artificial Sequence
  Description of Artificial Sequence: Synthetic polypeptide
MNKKVLTLSAVMASMLFGAAAHAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1175 - protein, 586 aa, Artificial Sequence
  Description of Artificial Sequence: Synthetic polypeptide
MMKRNILAVIVPALLVAGTANAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1176 - protein, 585 aa, Artificial Sequence
  Description of Artificial Sequence: Synthetic polypeptide
MKKTAIAIAVALAGFATVAQAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1177 - protein, 582 aa, Artificial Sequence
  Description of Artificial Sequence: Synthetic polypeptide
MRVLLFLLLSLFMLPAFSVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1178 - protein, 589 aa, Artificial Sequence
  Description of Artificial Sequence: Synthetic polypeptide
MMITLRKLPLAVAVAAGVMSAQAMAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1179 - protein, 586 aa, Artificial Sequence
  Description of Artificial Sequence: Synthetic polypeptide
MKYLLPTAAAGLLLLAAQPAMAVDYKDDDDKQLGGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGELGGSGKPIPNPLLGLDSTGSGHHHHHHHH

SEQ ID NO: 1180 - protein, 33 aa, Artificial Sequence
  Description of Artificial Sequence: Synthetic polypeptide
MGYKMNISSLRKAFIFMGAVAALSLVNAQSALA

SEQ ID NO: 1181 - protein, 19 aa, Artificial Sequence
  Description of Artificial Sequence: Synthetic peptide
MKKIWLALAGLVLAFSASA

SEQ ID NO: 1182 - protein, 21 aa, Artificial Sequence
  Description of Artificial Sequence: Synthetic peptide
MKQSTIALALLPLLFTPVTKA

SEQ ID NO: 1183 - protein, 21 aa, Artificial Sequence
  Description of Artificial Sequence: Synthetic peptide
MKQALRVAFGFLILWASVLHA

SEQ ID NO: 1184 - protein, 26 aa, Artificial Sequence
  Description of Artificial Sequence: Synthetic peptide
MKIKTGARILALSALTTMMFSASALA

SEQ ID NO: 1185 - protein, 23 aa, Artificial Sequence
  Description of Artificial Sequence: Synthetic peptide
MNKKVLTLSAVMASMLFGAAAHA

SEQ ID NO: 1186 - protein, 26 aa, Artificial Sequence
  Description of Artificial Sequence: Synthetic peptide
MTNITKRSLVAAGVLAALMAGNVALA

SEQ ID NO: 1187 - protein, 21 aa, Artificial Sequence
  Description of Artificial Sequence: Synthetic peptide
MKKTAIAIAVALAGFATVAQA

SEQ ID NO: 1188 - protein, 18 aa, Artificial Sequence
  Description of Artificial Sequence: Synthetic peptide
MRVLLFLLLSLFMLPAFS

SEQ ID NO: 1189 - protein, 25 aa, Artificial Sequence
  Description of Artificial Sequence: Synthetic peptide
MMITLRKLPLAVAVAAGVMSAQAMA

SEQ ID NO: 1190 - protein, 22 aa, Artificial Sequence
  Description of Artificial Sequence: Synthetic peptide
MKYLLPTAAAGLLLLAAQPAMA

SEQ ID NO: 1191 - protein, 518 aa, Artificial Sequence
  Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1192 - protein, 305 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPC

SEQ ID NO: 1193 - protein, 197 aa, Homo sapiens; identical to SEQ ID NO: 1053

SEQ ID NO: 1194 - protein, 16 aa, Artificial Sequence
  Description of Artificial Sequence: Synthetic peptide
SGGGGSGGGGSGGGGS

SEQ ID NO: 1195 - DNA, 711 bp, Artificial Sequence
  Description of Artificial Sequence: Synthetic polynucleotide
atggggtacaaaatgaacattagctcgcttcgcaaagcattcatttttatgggggctgttgcagctttaagccttgtcaatgcccagtcagcgcttgccatgatcacttgtccgccccccatgtctgtggaacacgcggatatttgggtaaagagctactcactgtacagccgtgaacgttatatttgtaactccggcttcaaacgcaaagcaggaacttcatcactgacggagtgtgttttaaataaagctactaacgtcgcgcactggactactccctcattgaagtgcatccgtgatcctgctctgggtggcgggggtagcggcgggggtggaagcgggggtggagggtctggaggaggtgggtctaactgggtgaatgttatctcagatttaaagaaaattgaagacctgatccaatctatgcacatcgacgctactctgtatacagaatcagatgtacatccttcgtgtaaagtgaccgcgatgaagtgttttttgcttgagctgcaagtaatttcccttgagtccggggacgcttcaatccatgacacggtcgagaacctgatcattctggcaaacaatagtttatcatcgaacggtaatgttaccgaatcgggttgcaaagaatgcgaagagttagaggaaaagaacattaaagaatttttgcaatccttcgttcacattgtgcagatgttcattaatacatcg

SEQ ID NO: 1196 - DNA, 666 bp, Artificial Sequence
  Description of Artificial Sequence: Synthetic polynucleotide
atgcgcgtgttattgttcttgctgctgagcttgtttatgttaccagctttcagtatgatcacttgtccgccccccatgtctgtggaacacgcggatatttgggtaaagagctactcactgtacagccgtgaacgttatatttgtaactccggcttcaaacgcaaagcaggaacttcatcactgacggagtgtgttttaaataaagctactaacgtcgcgcactggactactccctcattgaagtgcatccgtgatcctgctctgggtggcgggggtagcggcgggggtggaagcgggggtggagggtctggaggaggtgggtctaactgggtgaatgttatctcagatttaaagaaaattgaagacctgatccaatctatgcacatcgacgctactctgtatacagaatcagatgtacatccttcgtgtaaagtgaccgcgatgaagtgttttttgcttgagctgcaagtaatttcccttgagtccggggacgcttcaatccatgacacggtcgagaacctgatcattctggcaaacaatagtttatcatcgaacggtaatgttaccgaatcgggttgcaaagaatgcgaagagttagaggaaaagaacattaaagaatttttgcaatccttcgttcacattgtgcagatgttcattaatacatcg

SEQ ID NO: 1197 - DNA, 678 bp, Artificial Sequence
  Description of Artificial Sequence: Synthetic polynucleotide
atgaaatatcttcttccaacggctgctgctggtttattgcttcttgccgcccagcctgcgatggctatgatcacttgtccgccccccatgtctgtggaacacgcggatatttgggtaaagagctactcactgtacagccgtgaacgttatatttgtaactccggcttcaaacgcaaagcaggaacttcatcactgacggagtgtgttttaaataaagctactaacgtcgcgcactggactactccctcattgaagtgcatccgtgatcctgctctgggtggcgggggtagcggcgggggtggaagcgggggtggagggtctggaggaggtgggtctaactgggtgaatgttatctcagatttaaagaaaattgaagacctgatccaatctatgcacatcgacgctactctgtatacagaatcagatgtacatccttcgtgtaaagtgaccgcgatgaagtgttttttgcttgagctgcaagtaatttcccttgagtccggggacgcttcaatccatgacacggtcgagaacctgatcattctggcaaacaatagtttatcatcgaacggtaatgttaccgaatcgggttgcaaagaatgcgaagagttagaggaaaagaacattaaagaatttttgcaatccttcgttcacattgtgcagatgttcattaatacatcg

SEQ ID NO: 1198 - DNA, 612 bp, Artificial Sequence
  Description of Artificial Sequence: Synthetic polynucleotide
atgatcacttgtccgccccccatgtctgtggaacacgcggatatttgggtaaagagctactcactgtacagccgtgaacgttatatttgtaactccggcttcaaacgcaaagcaggaacttcatcactgacggagtgtgttttaaataaagctactaacgtcgcgcactggactactccctcattgaagtgcatccgtgatcctgctctgggtggcgggggtagcggcgggggtggaagcgggggtggagggtctggaggaggtgggtctaactgggtgaatgttatctcagatttaaagaaaattgaagacctgatccaatctatgcacatcgacgctactctgtatacagaatcagatgtacatccttcgtgtaaagtgaccgcgatgaagtgttttttgcttgagctgcaagtaatttcccttgagtccggggacgcttcaatccatgacacggtcgagaacctgatcattctggcaaacaatagtttatcatcgaacggtaatgttaccgaatcgggttgcaaagaatgcgaagagttagaggaaaagaacattaaagaatttttgcaatccttcgttcacattgtgcagatgttcattaatacatcg

SEQ ID NO: 1199 - protein, 20 aa, Artificial Sequence
  Description of Artificial Sequence: Synthetic peptide
GGGGSGGGGSGGGGSGGGGS

SEQ ID NO: 1200 - protein, 237 aa, Artificial Sequence
  Description of Artificial Sequence: Synthetic polypeptide
MGYKMNISSLRKAFIFMGAVAALSLVNAQSALAMITCPPPMSVEHADIWVKSYSLYSRERYICNSGFKRKAGTSSLTECVLNKATNVAHWTTPSLKCIRDPALGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1201 - protein, 222 aa, Artificial Sequence
  Description of Artificial Sequence: Synthetic polypeptide
MRVLLFLLLSLFMLPAFSMITCPPPMSVEHADIWVKSYSLYSRERYICNSGFKRKAGTSSLTECVLNKATNVAHWTTPSLKCIRDPALGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1202 - protein, 226 aa, Artificial Sequence
  Description of Artificial Sequence: Synthetic polypeptide
MKYLLPTAAAGLLLLAAQPAMAMITCPPPMSVEHADIWVKSYSLYSRERYICNSGFKRKAGTSSLTECVLNKATNVAHWTTPSLKCIRDPALGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1203 - protein, 204 aa, Artificial Sequence
  Description of Artificial Sequence: Synthetic polypeptide
MITCPPPMSVEHADIWVKSYSLYSRERYICNSGFKRKAGTSSLTECVLNKATNVAHWTTPSLKCIRDPALGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1204 - protein, 114 aa, Homo sapiens; identical to SEQ ID NO: 1057

SEQ ID NO: 1205 - protein, 73 aa, Artificial Sequence; identical to SEQ ID NO: 1061
  Description of Artificial Sequence: Synthetic polypeptide

SEQ ID NO: 1206 - protein, 94 aa, Artificial Sequence; identical to SEQ ID NO: 1073
  Description of Artificial Sequence: Synthetic polypeptide

SEQ ID NO: 1207 - DNA, 222 bp, Artificial Sequence; identical to SEQ ID NO: 1071
  Description of Artificial Sequence: Synthetic polynucleotide

SEQ ID NO: 1208 - DNA, 285 bp, Artificial Sequence
  Description of Artificial Sequence: Synthetic polynucleotide
atgaagcaaagtacgatcgcccttgcgctgttgccccttcttttcacgcccgtcaccaaggcagtgcccctgagccgcaccgtgcgttgtacgtgtatctccatctcaaaccagccggtaaacccgcgtagtttagaaaaactggagattatcccagccagccagttttgcccgcgcgttgagattattgcgaccatgaagaaaaaaggggaaaaacgttgccttaatccagaaagtaaggctatcaaaaacctgttgaaagctgtctcgaaagagcgttcctaa

SEQ ID NO: 1209 - protein, 273 aa, Artificial Sequence
  Description of Artificial Sequence: Synthetic polypeptide
MDFSNMSILHYLANIVDILVVWFVIYKVIMLIRGTKAVQLLKGIFIIIAVKLLSGFFGLQTVEWITDQMLTWGFLAIIIIFQPELRRALETLGRGNIFTRYGSRIEREQHHLIESIEKSTQYMAKRRIGALISVARDTGMDDYIETGIPLNAKISSQLLINIFIPNTPLHDGAVIIKGNEIASAASYLPLSDSPFLSKELGTRHRAALGISEVTDSITIVVSEETGGISLTKGGELFRDVSEEELHKILLKELVTVTAKKPSIFSKWKGGKSE

SEQ ID NO: 1210 - DNA, 822 bp, Artificial Sequence
  Description of Artificial Sequence: Synthetic polynucleotide
atggacttttccaacatgagtatccttcactatttagcgaatattgtagacattttggtggtttggttcgtaatttacaaggttatcatgcttatccgcggcacgaaagccgtccagctgttgaaggggattttcattattattgccgtcaagttacttagcggcttcttcggattgcagacagtggaatggattactgatcaaatgctgacttggggtttcttagccattatcattatctttcaaccggaattgcgtcgtgccctggagactttggggcgtggcaatatctttacccgctatggatcacgcattgagcgtgaacaacaccaccttattgagtctattgaaaagtccacgcaatacatggcgaagcgtcgcattggagctttgatctctgtggctcgtgatacaggcatggacgactacatcgagactggcattccgcttaatgcgaaaatctcatcgcaattattgattaatatcttcatccccaatacccctcttcacgatggcgcagtgatcattaaaggtaacgagatcgcgagcgctgccagttatctgccattgtccgactcgccgtttctttctaaggagctgggaactcgccatcgtgccgcattagggatttccgaggtgacagattcaatcacaatcgttgtcagcgaggaaacaggtgggatttcccttacgaagggaggcgaactgttccgtgatgtatccgaagaagaattgcataagattttgcttaaagagctggtgactgtcacagctaaaaaaccaagcattttctccaaatggaaaggaggtaagtccgagtga

SEQ ID NO: 1211 - DNA, 3787 bp, Artificial Sequence
  Description of Artificial Sequence: Synthetic polynucleotide
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacccgcatcccacgctaactaatataaggggggcaagaatggacttttccaacatgagtatccttcactatttagcgaatattgtagacattttggtggtttggttcgtaatttacaaggttatcatgcttatccgcggcacgaaagccgtccagctgttgaaggggattttcattattattgccgtcaagttacttagcggcttcttcggattgcagacagtggaatggattactgatcaaatgctgacttggggtttcttagccattatcattatctttcaaccggaattgcgtcgtgccctggagactttggggcgtggcaatatctttacccgctatggatcacgcattgagcgtgaacaacaccaccttattgagtctattgaaaagtccacgcaatacatggcgaagcgtcgcattggagctttgatctctgtggctcgtgatacaggcatggacgactacatcgagactggcattccgcttaatgcgaaaatctcatcgcaattattgattaatatcttcatccccaatacccctcttcacgatggcgcagtgatcattaaaggtaacgagatcgcgagcgctgccagttatctgccattgtccgactcgccgtttctttctaaggagctgggaactcgccatcgtgccgcattagggatttccgaggtgacagattcaatcacaatcgttgtcagcgaggaaacaggtgggatttcccttacgaagggaggcgaactgttccgtgatgtatccgaagaagaattgcataagattttgcttaaagagctggtgactgtcacagctaaaaaaccaagcattttctccaaatggaaaggaggtaagtccgagtgaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 1212 - DNA, 5519 bp, Artificial Sequence
  Description of Artificial Sequence: Synthetic polynucleotide
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttttaagacccactttcacatttaagttgtttttctaatccgcagatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaatgaaaggaggtaaattatgagcaacaatgccttgcagactattattaacgctcgtcttcccggcgaagaaggtctgtggcaaatccatcttcaggatggtaagatttctgccattgatgcccaaagcggggtgatgccaatcacggaaaattcactggatgcagaacagggcttggtaattccgccttttgtagaaccacacatccatttggatactacccagacggcgggtcaacccaactggaaccagagcggtacgcttttcgaagggatcgagcgctgggccgaacgtaaagctcttttgacacatgacgacgtaaagcaacgcgcgtggcagacactgaaatggcaaattgccaatgggattcagcatgtacgcacgcacgtggacgttagcgacgcgaccctgaccgcattaaaggccatgttggaagtgaagcaagaagtggccccttggatcgatctgcaaattgtagcttttccacaagagggtatccttagctacccgaacggagaagctcttttagaggaagcgctgcgcttgggcgctgacgttgtcggtgctattcctcactttgagtttacacgcgagtatggagttgagtcgcttcataagacgttcgctttggcccagaaatacgaccgtttaattgacgtacattgcgatgagatcgacgacgagcaatcccgctttgtagaaacagtcgccgcgttggcgcatcacgaaggcatgggtgcgcgcgtaaccgcctcgcacactactgctatgcactcgtacaacggagcgtatactagccgcctgtttcgcttgctgaaaatgagtggcattaactttgttgccaacccattggtcaatatccatttgcaaggtcgtttcgatacatatccaaaacgtcgtggcatcacccgtgtcaaagagatgctggagtctggcattaatgtgtgttttggacatgacgatgtattcgatccatggtatccgcttggcacggctaacatgttacaagtgttgcacatggggttgcatgtgtgccagttaatgggctacggtcagatcaatgatggcttaaacttaatcacacaccactccgcgcgcactctgaatttgcaagactacggcatcgcagcaggtaactcggccaacctgatcatcttacccgcagaaaacggctttgatgctttgcgccgtcaggtgccggtccgctatagtgtgcgtggtgggaaggttatcgcgtccacccaaccagcacagaccactgtgtaccttgaacagcccgaagctatcgactacaaacgctaaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 1213 - DNA, 1281 bp, Artificial Sequence
  Description of Artificial Sequence: Synthetic polynucleotide
atgagcaacaatgccttgcagactattattaacgctcgtcttcccggcgaagaaggtctgtggcaaatccatcttcaggatggtaagatttctgccattgatgcccaaagcggggtgatgccaatcacggaaaattcactggatgcagaacagggcttggtaattccgccttttgtagaaccacacatccatttggatactacccagacggcgggtcaacccaactggaaccagagcggtacgcttttcgaagggatcgagcgctgggccgaacgtaaagctcttttgacacatgacgacgtaaagcaacgcgcgtggcagacactgaaatggcaaattgccaatgggattcagcatgtacgcacgcacgtggacgttagcgacgcgaccctgaccgcattaaaggccatgttggaagtgaagcaagaagtggccccttggatcgatctgcaaattgtagcttttccacaagagggtatccttagctacccgaacggagaagctcttttagaggaagcgctgcgcttgggcgctgacgttgtcggtgctattcctcactttgagtttacacgcgagtatggagttgagtcgcttcataagacgttcgctttggcccagaaatacgaccgtttaattgacgtacattgcgatgagatcgacgacgagcaatcccgctttgtagaaacagtcgccgcgttggcgcatcacgaaggcatgggtgcgcgcgtaaccgcctcgcacactactgctatgcactcgtacaacggagcgtatactagccgcctgtttcgcttgctgaaaatgagtggcattaactttgttgccaacccattggtcaatatccatttgcaaggtcgtttcgatacatatccaaaacgtcgtggcatcacccgtgtcaaagagatgctggagtctggcattaatgtgtgttttggacatgacgatgtattcgatccatggtatccgcttggcacggctaacatgttacaagtgttgcacatggggttgcatgtgtgccagttaatgggctacggtcagatcaatgatggcttaaacttaatcacacaccactccgcgcgcactctgaatttgcaagactacggcatcgcagcaggtaactcggccaacctgatcatcttacccgcagaaaacggctttgatgctttgcgccgtcaggtgccggtccgctatagtgtgcgtggtgggaaggttatcgcgtccacccaaccagcacagaccactgtgtaccttgaacagcccgaagctatcgactacaaacgc

SEQ ID NO: 1214 - DNA, 4894 bp, Artificial Sequence
  Description of Artificial Sequence: Synthetic polynucleotide
tagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacggtgcaccctgcagggctagctgataaagcgttcgcgctgcattcggcagtttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaacttcacttattagggaggaaagaatatgtcaaataacgctctgcagactattataaatgctcgattgccaggggaagaggggttgtggcaaattcaccttcaggatgggaagatctctgcgatagatgcgcagtcgggcgtgatgccaatcactgaaaactctctcgacgcggaacagggcctggttattcctccgtttgttgagccacacattcaccttgatactacgcagacggcaggtcagcccaattggaatcagtctggtaccttgtttgaggggatagagcggtgggccgaacgtaaggcattgctgacccacgatgatgtcaaacagcgcgcttggcagactttaaagtggcaaattgcgaatggcatccagcatgttagaacacacgtggatgtgtcggatgctactctgacggctctgaaagcgatgcttgaagttaagcaggaggttgccccgtggatcgatctgcaaattgttgcattcccgcaggagggcatcctcagctatccgaacggtgaggcgcttctcgaagaagctctcagacttggagcggacgttgtgggcgcgatcccgcatttcgaattcactcgcgagtacggtgtggaatcacttcacaaaacctttgcgctggcacagaagtatgaccgacttattgatgtacattgcgatgaaatagatgatgagcagtccagattcgttgaaaccgttgcagcgttggctcatcacgagggcatgggcgcacgcgtcactgcctcccacacgaccgcgatgcattcgtataacggtgcatacacctcacgcctgtttcggctgttaaaaatgagcggaataaacttcgtcgctaatccattggttaatattcatttgcagggtcgctttgatacgtatccaaaaagacgcggcataacgcgagtcaaagaaatgctggagagtggtatcaatgtgtgctttggccacgatgatgttttcgatccctggtatccgcttggaacggcgaatatgcttcaggttctgcacatggggctgcacgtgtgccagctgatgggttacggacaaattaacgatggcctgaatctcatcacccatcattctgcccgaactcttaacctgcaggattatggaattgcggcgggcaattctgctaatctgataatactgcctgctgaaaacggtttcgacgcgctccgccgacaagtgcccgttcgttacagtgttcgaggcggcaaagtcatcgcgtcaactcaaccagctcaaactactgtatatctggaacagcccgaagctattgactacaaacgaggctcagattataaggacgatgatgataaaggtagcaaaatagttgaagttaaacatcccctcgttaaacacaaactgggcttgatgcgcgaacaggacatatcgaccaaacgcttccgtgaactggcttcagaagtgggctcactactgacgtatgaagcaaccgcagatcttgagacagaaaaagtaactattgaaggctggaatggccccgtagagatagatcagatcaaaggtaaaaaaattacggtcgttccgattttgcgcgccgggctgggcatgatggatggagtgttagaaaacgtcccatccgcccggatctcggtggtcggaatgtaccgcaacgaagagacgcttgaaccagtcccttacttccagaagttggttagtaacatagacgaacgaatggccttaatagtagatccgatgctcgcgactggcggcagcgtgatcgctacgattgatctgttgaaaaaagcggggtgtagttctatcaaagttctggttctcgtcgcggcgccagaaggtattgccgcgttagaaaaagcacatccggacgtcgaactgtacactgcatctattgaccagggattgaacgagcatggatatataattccgggcttgggcgatgcgggagataaaatcttcggtactaagtaaggaggaacgattggtaaacccggtgaacgcatgagaaagcccccggaagatcaccttccgggggcttttttattgcgcggaccaaaacgaaaaaagacgctcgaaagcgtctcttttctggaatttggtaccgaggcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgc

SEQ ID NO: 1215 - DNA, 1941 bp, Artificial Sequence
  Description of Artificial Sequence: Synthetic polynucleotide
atgtcaaataacgctctgcagactattataaatgctcgattgccaggggaagaggggttgtggcaaattcaccttcaggatgggaagatctctgcgatagatgcgcagtcgggcgtgatgccaatcactgaaaactctctcgacgcggaacagggcctggttattcctccgtttgttgagccacacattcaccttgatactacgcagacggcaggtcagcccaattggaatcagtctggtaccttgtttgaggggatagagcggtgggccgaacgtaaggcattgctgacccacgatgatgtcaaacagcgcgcttggcagactttaaagtggcaaattgcgaatggcatccagcatgttagaacacacgtggatgtgtcggatgctactctgacggctctgaaagcgatgcttgaagttaagcaggaggttgccccgtggatcgatctgcaaattgttgcattcccgcaggagggcatcctcagctatccgaacggtgaggcgcttctcgaagaagctctcagacttggagcggacgttgtgggcgcgatcccgcatttcgaattcactcgcgagtacggtgtggaatcacttcacaaaacctttgcgctggcacagaagtatgaccgacttattgatgtacattgcgatgaaatagatgatgagcagtccagattcgttgaaaccgttgcagcgttggctcatcacgagggcatgggcgcacgcgtcactgcctcccacacgaccgcgatgcattcgtataacggtgcatacacctcacgcctgtttcggctgttaaaaatgagcggaataaacttcgtcgctaatccattggttaatattcatttgcagggtcgctttgatacgtatccaaaaagacgcggcataacgcgagtcaaagaaatgctggagagtggtatcaatgtgtgctttggccacgatgatgttttcgatccctggtatccgcttggaacggcgaatatgcttcaggttctgcacatggggctgcacgtgtgccagctgatgggttacggacaaattaacgatggcctgaatctcatcacccatcattctgcccgaactcttaacctgcaggattatggaattgcggcgggcaattctgctaatctgataatactgcctgctgaaaacggtttcgacgcgctccgccgacaagtgcccgttcgttacagtgttcgaggcggcaaagtcatcgcgtcaactcaaccagctcaaactactgtatatctggaacagcccgaagctattgactacaaacgaggctcagattataaggacgatgatgataaaggtagcaaaatagttgaagttaaacatcccctcgttaaacacaaactgggcttgatgcgcgaacaggacatatcgaccaaacgcttccgtgaactggcttcagaagtgggctcactactgacgtatgaagcaaccgcagatcttgagacagaaaaagtaactattgaaggctggaatggccccgtagagatagatcagatcaaaggtaaaaaaattacggtcgttccgattttgcgcgccgggctgggcatgatggatggagtgttagaaaacgtcccatccgcccggatctcggtggtcggaatgtaccgcaacgaagagacgcttgaaccagtcccttacttccagaagttggttagtaacatagacgaacgaatggccttaatagtagatccgatgctcgcgactggcggcagcgtgatcgctacgattgatctgttgaaaaaagcggggtgtagttctatcaaagttctggttctcgtcgcggcgccagaaggtattgccgcgttagaaaaagcacatccggacgtcgaactgtacactgcatctattgaccagggattgaacgagcatggatatataattccgggcttgggcgatgcgggagataaaatcttcggtactaagtaa

SEQ ID NO: 1216 - protein, 427 aa, Artificial Sequence
  Description of Artificial Sequence: Synthetic polypeptide
MSNNALQTIINARLPGEEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHHEGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 1217 - protein, 646 aa, Artificial Sequence
  Description of Artificial Sequence: Synthetic polypeptide
MSNNALQTIINARLPGEEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHHEGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKRGSDYKDDDDKGSKIVEVKHPLVKHKLGLMREQDISTKRFRELASEVGSLLTYEATADLETEKVTIEGWNGPVEIDQIKGKKITVVPILRAGLGMMDGVLENVPSARISVVGMYRNEETLEPVPYFQKLVSNIDERMALIVDPMLATGGSVIATIDLLKKAGCSSIKVLVLVAAPEGIAALEKAHPDVELYTASIDQGLNEHGYIIPGLGDAGDKIFGTK

SEQ ID NO: 1218 - protein, 52 aa, Artificial Sequence
  Description of Artificial Sequence: Synthetic polypeptide
MKRHLNTSYRLVWNHITGAFVVASELARARGKRAGVAVALSLAAATSLPALA

SEQ ID NO: 1219 - protein, 53 aa, Artificial Sequence
  Description of Artificial Sequence: Synthetic polypeptide
MNKIFKVIWNPATGSYTVASETAKSRGKKSGRSKLLISALVAGGLLSSFGASA

SEQ ID NO: 1220 - protein, 22 aa, Artificial Sequence
  Description of Artificial Sequence: Synthetic peptide
MQLRKPATAILALALSAGLAQA

SEQ ID NO: 1221 - protein, 40 aa, Artificial Sequence
  Description of Artificial Sequence: Synthetic polypeptide
MFWRDMTLSVWRKKTTGLKTKKRLLALVLAAALCSSPVWA

SEQ ID NO: 1222 - DNA, 159 bp, Artificial Sequence
  Description of Artificial Sequence: Synthetic polynucleotide
atgaacaagattttcaaggttatctggaaccccgcgacaggcagctacactgtggcctccgaaaccgctaagtcgcgcggcaagaagtcaggacgttcaaagctgcttatttctgctttagtagccggaggattactttctagctttggagcctcggca

SEQ ID NO: 1223 - DNA, 57 bp, Artificial Sequence
  Description of Artificial Sequence: Synthetic oligonucleotide
atgaaaaaaatctggctggcattagcaggcttagtcctggcctttagtgcctcggca

SEQ ID NO: 1224 - DNA, 66 bp, Artificial Sequence
  Description of Artificial Sequence: Synthetic oligonucleotide
atgcagttgcgcaagcctgccacggcaattttagcattagctctttctgcgggcttggcccaggca

SEQ ID NO: 1225 - DNA, 120 bp, Artificial Sequence
  Description of Artificial Sequence: Synthetic polynucleotide
atgttctggcgcgacatgacactgagcgtttggcgtaaaaaaacaacgggactgaaaaccaaaaagcgtttgttagcccttgtcctggcggcagccctgtgctcgtccccggtatgggca

SEQ ID NO: 1226 - DNA, 99 bp, Artificial Sequence
  Description of Artificial Sequence: Synthetic oligonucleotide
atgggatacaagatgaacatttcatcacttcgcaaagcttttatcttcatgggtgccgttgctgctctgtcactggtcaatgctcaatcggccctggca

SEQ ID NO: 1227 - DNA, 78 bp, Artificial Sequence
  Description of Artificial Sequence: Synthetic oligonucleotide
atgaagattaaaacaggcgctcgtattttggccctgtctgcgcttacgactatgatgtttagtgcctcggccctggca

SEQ ID NO: 1228 - DNA, 78 bp, Artificial Sequence
  Description of Artificial Sequence: Synthetic oligonucleotide
atgacgaatatcactaaacgtagccttgtggccgcgggggtcttggctgcattgatggctggcaatgttgctctggca

SEQ ID NO: 1229 - DNA, 66 bp, Artificial Sequence
  Description of Artificial Sequence: Synthetic oligonucleotide
atgaaatatctgttgcccacggctgccgcgggtctgctgctgctggcagcgcaaccggctatggca

SEQ ID NO: 1230 - DNA, 63 bp, Artificial Sequence
  Description of Artificial Sequence: Synthetic oligonucleotide
atgaagcaaagtacgatcgcccttgcgctgttgccccttcttttcacgcccgtcaccaaggca

SEQ ID NO: 1231 - protein, 343 aa, Homo sapiens
EEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIY

SEQ ID NO: 1232 - DNA, 342 bp, Artificial Sequence
  Description of Artificial Sequence: Synthetic polynucleotide
aactgggtgaatgtcatctcggacttaaagaagattgaagacttgattcagagcatgcatatcgacgcgactttatacaccgagtctgacgtacacccaagttgcaaggtcaccgccatgaagtgcttcttgcttgagttacaagtcatcagtttggaatctggagacgctagtattcacgatacggtggaaaacctgatcatccttgcaaatgactctctttcatccaatggtaatgttactgagtcggggtgcaaagaatgtgaagaacttgaggagaagaacattaaggaatttcttcagtcattcgtgcatatcgtacagatgttcatcaacacctct

SEQ ID NO: 1233 - DNA, 60 bp, Artificial Sequence
  Description of Artificial Sequence: Synthetic oligonucleotide
tccggagggagcggcggcgggggtagtggaggcgggtcaggcggcgggggctcacttcag

SEQ ID NO: 1234 - DNA, 36 bp, Artificial Sequence
  Description of Artificial Sequence: Synthetic oligonucleotide
gattataaagacgatgacgataagatcgaaggacgt

SEQ ID NO: 1235 - DNA, 1791 bp, Artificial Sequence
  Description of Artificial Sequence: Synthetic polynucleotide
atggggtacaaaatgaacattagctcgcttcgcaaagcattcatttttatgggggctgttgcagctttaagccttgtcaatgcccagtcagcgcttgccgtcgactataaggatgacgacgacaagcaattgggcggtggcatctgggagcttaagaaggacgtgtatgtagtggagttagactggtatccagatgcccccggagagatggtggtcttaacatgtgacactccagaggaggacgggattacctggacacttgaccagtcaagcgaggtattgggttctggaaagacgcttactattcaagtcaaagaatttggggatgccgggcagtatacatgtcacaagggcggcgaagttctgtcgcactccttacttttgttacacaaaaaagaagacggcatttggtccacagacatccttaaggaccaaaaggagccgaagaataagacgtttctgcgctgtgaagcgaagaactatagtggtcgctttacttgctggtggttgacgaccatttccactgatttaaccttttcggtaaagagttctcgcgggagttccgacccacagggcgtgacttgtggcgcagccacactttcggcggaacgcgttcgtggggacaataaggaatacgaatattcggtcgagtgtcaggaagattcagcttgccctgccgctgaggagtcacttccgattgaagtgatggttgacgccgtgcacaaattaaagtatgaaaattacacgtcatctttctttatccgtgacattattaagcccgacccgccaaagaatctgcagcttaaacccctgaagaacagccgccaggtggaagtaagctgggaatatcctgacacctggtccactccgcattcgtatttctcgttgacgttttgtgttcaggtgcagggaaagagcaagcgcgaaaagaaggatcgcgtctttacagacaaaacgtccgcgacggttatttgtcgtaagaatgctagtatctctgttcgcgctcaggaccgttattactcatctagttggtcggagtgggcctcggttccctgctctgggggtggaggatcgggtggaggtggctcgggaggtggcggctcccgtaatttaccggtggctactcctgacccagggatgttcccgtgcttgcaccatagccaaaacttacttcgcgctgtcagcaacatgcttcagaaagcacgtcaaacgcttgagttttacccgtgtactagcgaagagatcgatcacgaggacattaccaaagacaaaacctccaccgtcgaggcctgccttccacttgaactgacgaaaaatgagtcatgcttaaattctcgtgaaacctccttcattactaacggatcgtgcctggcctcgcgcaagacttcgttcatgatggcattatgcttgtcgtctatttatgaagaccttaaaatgtatcaagtggagttcaagacgatgaatgcaaaacttcttatggacccgaagcgtcaaatcttcttagaccaaaacatgttggccgtgatcgatgaactgatgcaagccttgaattttaattcggaaactgtaccgcaaaaatcttctcttgaagaaccggatttctataagaccaaaattaaactttgtattttacttcacgctttccgcatccgtgcagtaactatcgaccgcgtaatgagttaccttaacgcctcgggtggcgagctcggtggcagtggtaagcctatccctaaccctctcctcggcctcgattctacgggatccggtcatcaccaccatcaccatcaccat

SEQ ID NO: 1236 - protein, 69 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPAL

SEQ ID NO: 1237 - DNA, 72 bp, Artificial Sequence; identical to SEQ ID NO: 1141
  Description of Artificial Sequence: Synthetic oligonucleotide

SEQ ID NO: 1238 - protein, 18 aa, Artificial Sequence
  Description of Artificial Sequence: Synthetic peptide
KESGSVSSEQLAQFRSLD

SEQ ID NO: 1239 - protein, 14 aa, Artificial Sequence
  Description of Artificial Sequence: Synthetic peptide
EGKSSGSGSESKST

SEQ ID NO: 1240 - protein, 8 aa, Artificial Sequence
  Description of Artificial Sequence: Synthetic peptide
GGGGGGGG

SEQ ID NO: 1241 - protein, 12 aa, Artificial Sequence
  Description of Artificial Sequence: Synthetic peptide
GSAGSAAGSGEF

SEQ ID NO: 1242 - protein, 30 aa, Artificial Sequence
  Description of Artificial Sequence: Synthetic polypeptide
  MISC_FEATURE (1)..(30): This sequence may encompass 1-6 'Gly Gly Gly Gly Ser' repeating units
GGGGSGGGGSGGGGSGGGGSGGGGSGGGGS

SEQ ID NO: 1243 - protein, 16 aa, Artificial Sequence
  Description of Artificial Sequence: Synthetic peptide
SGGGGSGGGGSGGGGS

SEQ ID NO: 1244 - protein, 9 aa, Artificial Sequence
  Description of Artificial Sequence: Synthetic peptide
GGGGSGGGS

SEQ ID NO: 1245 - protein, 5 aa, Artificial Sequence
  Description of Artificial Sequence: Synthetic peptide
GGGGS

SEQ ID NO: 1246 - DNA, 18 bp, Artificial Sequence
  Description of Artificial Sequence: Synthetic oligonucleotide
  modified_base (2)..(2): a, c, t, g, unknown or other
  modified_base (17)..(17): a, c, t, g, unknown or other
wntgaatwwwwattcanw

SEQ ID NO: 1247 - protein, 15 aa, Artificial Sequence
  Description of Artificial Sequence: Synthetic peptide
GGGGSGGGGSGGGGS

SEQ ID NO: 1248 - protein, 6 aa, Artificial Sequence
  Description of Artificial Sequence: Synthetic peptide
  MOD_RES (6)..(6): 1,3 dimethyl-His
CAVAYH

SEQ ID NO: 1249 - DNA, 18 bp, Artificial Sequence
  Description of Artificial Sequence: Synthetic oligonucleotide
ttgttgayryrtcaacwa

SEQ ID NO: 1250 - DNA, 24 bp, Artificial Sequence
  Description of Artificial Sequence: Synthetic oligonucleotide
ggaaaatttttttaaaaaaaaaac

SEQ ID NO: 1251 - protein, 8 aa, Artificial Sequence
  Description of Artificial Sequence: Synthetic peptide
AGYGSTLT

SEQ ID NO: 1252 - protein, 6 aa, Artificial Sequence
  Description of Artificial Sequence: Synthetic 6xHis tag
HHHHHH

SEQ ID NO: 1253 - DNA, 57 bp, Artificial Sequence
  Description of Artificial Sequence: Synthetic oligonucleotide
atgaagaaaatttggctggcacttgccggtttggtattagcgttttccgcctcggca

The invention claimed is:

1. A genetically engineered bacterium comprising at least one non-native gene sequence encoding an enzyme capable of producing a stimulator of interferon gene (STING) agonist, wherein the non-native gene sequence is a dacA (diadenylate cyclase) gene, wherein the dacA gene is operatively linked to an inducible promoter, and wherein the bacterium is an auxotroph in dapA (4-hydroxy-tetrahydrodipicolinate synthase) and thyA (thymidylate synthase).

2. The genetically engineered bacterium of claim 1, wherein the STING agonist is c-di-AMP.

3. The genetically engineered bacterium of claim 1, wherein the dacA gene sequence is integrated into a chromosome of the bacterium or is present on a plasmid in the bacterium.

4. The genetically engineered bacterium of claim 1, wherein inducible promoter is induced by low-oxygen or anaerobic conditions.

5. The genetically engineered bacterium of claim 1, wherein inducible promoter is induced by a hypoxic environment of a tumor.

6. The genetically engineered bacterium of claim 1, wherein the bacterium is non-pathogenic.

7. The genetically engineered bacterium of claim 6, wherein the bacterium is *Escherichia coli* Nissle.

8. A pharmaceutical composition comprising the genetically engineered bacterium of claim 1 and a pharmaceutically acceptable carrier.

9. A method of treating cancer in a subject, the method comprising administering the pharmaceutical composition of claim 8 to the subject, thereby treating cancer in the subject.

10. The method of claim 9, wherein the administering is via intratumoral injection.

* * * * *